United States Patent 11,098,302 (IDENTIFICATION OF POLYNUCLEOTIDES ASSOCIATED WITH A SAMPLE) - sequence listing, part 81

SEQ ID NO: 278803 - DNA, 507 bp, Homo sapiens
  misc_feature: GYAE6OF02H8CTL.19.71.G05.1.454.CMB.1.raw
  modified_base (238)..(238): a, c, t, g, unknown or other
  misc_feature (238)..(238): n is a, c, g, or t
  modified_base (383)..(383): a, c, t, g, unknown or other
  misc_feature (383)..(383): n is a, c, g, or t
  modified_base (485)..(485): a, c, t, g, unknown or other
  misc_feature (485)..(485): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactcncaccatcagcagccctgcaggctgaagatgtgctagtttattattgtacaacaatattattatacttcgtagacgttcggaccaagggccaaggtggattancgagacgaactgtggtctgacc

SEQ ID NO: 278804 - DNA, 532 bp, Homo sapiens
  misc_feature: GYAE6OF02F9I0G.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcggtctgggacagatttcactctcaccatcagcagcctgcaggctgaagatgtggctagtttattattgtacaactaattatttaattatactttcgtggtaccgtttcggccaaggggaccctaaagggttgggaacttaagtcaggaccgtaaactggtcggacttgaccc

SEQ ID NO: 278805 - DNA, 519 bp, Homo sapiens
  misc_feature: GYAE6OF02F4LOG.19.71.G05.1.454.CMB.1.raw
  modified_base (329)..(329): a, c, t, g, unknown or other
  misc_feature (329)..(329): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttacnggcatctacccgggaatccgggtcctgaccgattcagtggcagcgggtctgggacagatttcactctcaccatcagcagcctgcaggctgaagagtgtgctagtttattatgtacaactaattattattattacttcgttaggtacgttcggacctaagggtacctaaagggtggaattactacgaacgg

SEQ ID NO: 278806 - DNA, 344 bp, Homo sapiens
  misc_feature: GYAE6OF02HU20W.19.71.G05.1.454.CMB.1.raw
  modified_base (331)..(331): a, c, t, g, unknown or other
  misc_feature (331)..(331): n is a, c, g, or t
  modified_base (337)..(344): a, c, t, g, unknown or other
  misc_feature (337)..(344): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttctcccagcccccatagacatgccacctcgtctctggtgctatattggggccagggaacccatgtcaccgtctcctcggcctccaccaagggcccatcggtcttcccctggcgccctgctccaggagcacctccgagagcacagcggccctgggctgcctggtcaaggctacttcccacgagagtactgagcgggctggcaaggcncatagnnnnnnnn

SEQ ID NO: 278807 - DNA, 605 bp, Homo sapiens
  misc_feature: GYAE6OF02GO43K.19.71.G05.1.454.CMB.1.raw
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccagagtgttttatacagctccaacaataagaactacttaacttggtatcagcagaaaccaggacagcctcctaaggtgcctntacttcgnggacatccggtaaccggacgtcccgggtcctcgaccgtactcgaggtcgcgacggtcggtcggtacggacaggttacttaccgacttccgacgacgactacgtcgacgggcccggtcctggaccgtacggtcgtaaggaaacgtgttgggtcggtacttagttttacttcgtgtacgagtacttaattattaatctacctaccttcccgtacgtaccgttccggaccggtaacggaccggtagggtaacgaacgtaaccgaaacgtacgtggtacgcgtacgacctaaccg

SEQ ID NO: 278808 - DNA, 533 bp, Homo sapiens
  misc_feature: GYAE6OF02JAAJF.19.71.G05.1.454.CMB.1.raw
  modified_base (312)..(312): a, c, t, g, unknown or other
  misc_feature (312)..(312): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttacngggcatctaccgggatccggggtccctgaccgattcagtggcagcgggtctgggacagatttcactctcaccatcagcagcctgcaggctgagatgtgctagtttattattgtacaactaattattaattatactttcgtaggtaccgttcggacctaaggggccctaaaggtgggaattaacgtcgaaggtaccgtaaacttggtacggccttagacccg

SEQ ID NO: 278809 - DNA, 506 bp, Homo sapiens
  misc_feature: GYAE6OF02I4XCX.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttaagcttggtaccagcagagaccaggacagcctcctaggctgctcatttactgggcatctacccgggaatccggggtccctgaccgattcagtggcagcgggtctgggacagatttcactctcaccatcagcagcctgcaggctagaacgatgtgctagtttattattgtcaactaatattattatacttcgtagtacgttcggccaagggccaaggtggaatatacgagacgaactgtggctgac

SEQ ID NO: 278810 - DNA, 553 bp, Homo sapiens
  misc_feature: GYAE6OF02F0DV0.19.71.G05.1.454.CMB.1.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgcacgactgactaagtccagcacatctttanacagtcaanatagaaactactagcttagacagcagacgaccaggacagcctcaggctgactnattacnggcatcgtaccggatccgggtcctagaccgattcgagtggcaggtcgggtcngggactagtactttcactctcactatacgagcacgcctcgcgacgacgtagaagtagtgtgtacgtagtttattagttagtactaactaattaatttaattaattacgttacgttacggtacgttacgtacgtaacggtaacggtaaggtacggtaagtagtacgtacgacgaacgtaggtacggtacgtacgtcg

SEQ ID NO: 278811 - DNA, 510 bp, Homo sapiens
  misc_feature: GYAE6OF02HB3WJ.19.71.G05.1.454.CMB.1.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaaactacttagcttggtaccagcagagaccaggacagcctcctaggctgctcatttacnggcatctacccgggaatccggggtcctgaccgattcagtggcaggcggtctgggacagatttcactctcacctatcagcagcctgcaggctgaagntgtgcagtttatattgtacaaacattattattatacttcgtggacgtttcggaccaagggtaccaaggtggaattagtcaagacgtaactggtaggctgacc

SEQ ID NO: 278812 - DNA, 506 bp, Homo sapiens
  misc_feature: GYAE6OF02F3GOC.19.71.G05.1.454.CMB.1.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
  modified_base (407)..(407): a, c, t, g, unknown or other
  misc_feature (407)..(407): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggccaccgatcgaactgcaagtccagccacaatcttttanacagttccaacaatgaaaactacttagcttggtaccagcagagaccaggacagcctctaggctgctcatttacnggcatctacccggaatccggggtcctgaccgattcagtggcagcggtctgggacagatttcactctcacatcagcagctgcagctgagatgngctagtttatatgtcaactatattattatacttcgtggacgttcggaccaagggacctaaggtcggatagtacgagacgtaacgtggtacggtctgacc

SEQ ID NO: 278813 - DNA, 224 bp, Homo sapiens
  misc_feature: GYAE6OF02GPNMH.19.71.G05.1.454.CMB.1.raw
  modified_base (218)..(224): a, c, t, g, unknown or other
  misc_feature (218)..(224): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggctggcaaggcgcatagnnnnnnn

SEQ ID NO: 278814 - DNA, 521 bp, Homo sapiens
  misc_feature: GYAE6OF02IZJTC.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctccaggctgctcatttactgggcatctacccgggaatcccggggtccctgaccgattcagtggcagcgggtctgggacagatttcactctcaccatcagcagcctgcagctagagatgtggctagtttattagttgtactaacaatattattatactttcgtggtacgttcggaccgtaagggaaccgtaagggtaggtataatacaaggtaccgaactagg

SEQ ID NO: 278815 - DNA, 500 bp, Homo sapiens
  misc_feature: GYAE6OF02G1GOD.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttgtgacgttcggccaagggaccaaggtggattatcagacgaactgtggctgacc

SEQ ID NO: 278816 - DNA, 497 bp, Homo sapiens
  misc_feature: GYAE6OF02F089T.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcggtctgggacagatttcactctcaccatcagcagcctgcaggctgagatgtgcagtttattattgtcaacaatattattatacttcgtgacgttcggacaagggccaaggtggatatcagacgaactgtggctgtac

SEQ ID NO: 278817 - DNA, 505 bp, Homo sapiens
  misc_feature: GYAE6OF02GH2BK.19.71.G05.1.454.CMB.1.raw
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctctaggctgctcatttactgggcatctaccgggaatccggggtccctgaccgattcagtggcagcgggtctgggacagatttcactctcaccatcagcagcctgcaggctgaagntgtgcagtttatattgtcaaataatattattatacttcgtagtacgttcggacgaagggaccaaggtggaatatcgagacgaacgtgtggactgacc

SEQ ID NO: 278818 - DNA, 542 bp, Homo sapiens
  misc_feature: GYAE6OF02IFAMG.19.71.G05.1.454.CMB.1.raw
  modified_base (236)..(236): a, c, t, g, unknown or other
  misc_feature (236)..(236): n is a, c, g, or t
  modified_base (407)..(407): a, c, t, g, unknown or other
  misc_feature (407)..(407): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcagctgaagntgtgcagtttattattgtcaaataattattaattattacttcgtaggtaccgtttacggaccgtaagggtacctaagggtggaattaagtaccgaaggtaaccggtaaccgttagggtcggtaccgtagtacccg

SEQ ID NO: 278819 - DNA, 511 bp, Homo sapiens
  misc_feature: GYAE6OF02F53P2.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactggcatctacccgggaatccggggtccctgaccgattcagtggcagcgggtctgggacagatttcactctcaccatcagcagcctgcaggctagaagatgtgctagtttattattgtacaactaatatttattatacttgtgtacgttcgaccgaagggtaccaaggtgatagtacgagacgtaactggtcggctgacc

SEQ ID NO: 278820 - DNA, 558 bp, Homo sapiens
  misc_feature: GYAE6OF02J1PZI.19.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctaccgggatccgggcctgaccgattcagtggcagcgggtctgggacagatttcactctcaccatcacgcagcctgcaggctagaacgtagtgtggactagttttattattcgtactaaactaattaatttaattacttacgttcggtaggtaccgtttacggaccgtaaggggtaaccctaagggttaggtaattaacgtacgaaggtaccggtaaacgttggtacggtctacgtaaccg

SEQ ID NO: 278821 - DNA, 645 bp, Homo sapiens
  misc_feature: GYAE6OF02HIOVL.19.71.G05.1.454.CMB.1.raw
  modified_base (242)..(242): a, c, t, g, unknown or other
  misc_feature (242)..(242): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgactcgacaagtccagccacaatcttttanacagttaccaacaatagaaaactactagtcttacggtaccagacaagacgaccaggacacgcctccgtaggctgctactagtttacgnggactacttaccgtaacccggggactcccggggtaccctaggaaccgtattaccgaggtcggacgtacgggtcgggttacgtagggaactagtactttccaccttacgtaccaacctatcacgctacgcctgacgtagactaggaagtgtcgtcggtacttaggtttattagttacgtaactaaacttaattatttaactttaacgttacgtttcggtacggtaccgtttaccgggaccgtaaacggggaaccgtaagggtagtaacgttactacggaacggtaaccgtaacgttcggtacggtaccttacgacc

SEQ ID NO: 278822 - DNA, 524 bp, Homo sapiens
  misc_feature: GYAE6OF02HPAUS.19.71.G05.1.454.CMB.1.raw
  modified_base (254)..(254): a, c, t, g, unknown or other
  misc_feature (254)..(254): n is a, c, g, or t
  modified_base (322)..(322): a, c, t, g, unknown or other
  misc_feature (322)..(322): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctnatttactggcatcgtacccgggaatcccggggtcctgaccgattcagtggcaggcgggtctgggacagtatttcactctcaccatcagcagcctgcaggctagaagatgtgctagtttattagtgtacaactaattattatttatactttcgtaggtacgttcggaccgtaagggacccaaagggttggaattatcgaacgg

SEQ ID NO: 278823 - DNA, 522 bp, Homo sapiens
  misc_feature: GYAE6OF02GZIYG.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggatccggggtccctgaccgattcagtgcagcgggtctgggacagatttcactctcaccatcagcagcctgcaggctagaagntgtggctagtttattattgtacaactaattattaattattacttcgtggtacgttcggaccgtaagggacctaaggtggaatagtacgagacgtaacgtgtacggtctgtacc

SEQ ID NO: 278824 - DNA, 512 bp, Homo sapiens
  misc_feature: GYAE6OF02HMON7.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (410)..(410): a, c, t, g, unknown or other
  misc_feature (410)..(410): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtccctgaccgattcagtggcagcgggtctgggacagatttcactctcacatcagcagcctgcaggctagaagntgtgctagttttatattgtacaaactaatatttattaatacttcgtgtacgttcggacctaagggtaccaaggtgaatagtcagacgaactggtggctgacc

SEQ ID NO: 278825 - DNA, 344 bp, Homo sapiens
  misc_feature: GYAE6OF02G8ZKO.19.71.G05.1.454.CMB.1.raw
  modified_base (340)..(344): a, c, t, g, unknown or other
  misc_feature (340)..(344): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttctcccagcccccatagacatgccacctcgtctctggtgctatattggggccagggaacccatgtcaccgtctcctcggcctccaccaagggcccatcggtcttccccctggcgccctgctccaggagcacctccgagagcacagcggccctgggctgcctggtcaaggactacttcccacgagagtactgagcgggctggcaaggcgcatagnnnnn

SEQ ID NO: 278826 - DNA, 617 bp, Homo sapiens
  misc_feature: GYAE6OF02IZMF6.19.71.G05.1.454.CMB.1.raw
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (496)..(496): a, c, t, g, unknown or other
  misc_feature (496)..(496): n is a, c, g, or t
tcagtactctcgtgcacgaccggtgctcgatttagtgtcgtcgcaagagagagggggagggtacgaacaggcgaggcgaggggcgagcaagatggtgttgcagacccaggtcttcatttctctgttgctctggatctctggtgcccacggggacatcgtgatgacccagtctccagactccctggctgtgtctctgggcgaggcgggccaccatcactgcaagtccagccacaatcttttanacagttccaacaatagaaactattagcttgtaccagcagagacccaggacacgcctccgtaaggctcgctctactttacgnggggccaatccgtaacccggggtaagttcccgggggtaccccttgaaccgttatccgaggtcggacagggtcccgggtgtaggggactacgtactttcgacctctaccactaagtccaacgtcacgccttcggacacggtcgtagtaacggtagtcgcggttactaaggtttnttaagtttcgtacctaaacgtaattattaattacttaacgttcgtggttaacgttccgacgtaaccggtacgaggttacggatacgttacgaacggtacgtactggttagcgtacgtaccg

SEQ ID NO: 278827 - DNA, 538 bp, Homo sapiens
  misc_feature: GYAE6OF02J1QEG.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacaggtactttcacgtctcacctatcgagcacgcctgccaggctagaagagtgtgctagtttattagttgtacaactaattagttaacttaattacttcgtagtaccgttcggacctaagggtaacctaaggtggaattatacgagacgtaactggtcggtctgtaccg

SEQ ID NO: 278828 - DNA, 506 bp, Homo sapiens
  misc_feature: GYAE6OF02IIIW0.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggctatctaccgggaatccggggtccctgaccgattcagtgcagcgggtctgggacagatttcactctcaccatcagcagcctgcaggctgaagatggtgctagtttattattagtcaaactaatattattaatacttcgtagtacgttcgacaagggacaaggtggaatatacagacgtaatgtggctgac

SEQ ID NO: 278829 - DNA, 503 bp, Homo sapiens
  misc_feature: GYAE6OF02F9GEI.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatctttatacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctgaagatgtggcagtttattattgtcaacaatattattatacttcgtgacgttgaccaagggaccaaggtggatatcgagacgtaactgtaggctgacc

SEQ ID NO: 278830 - DNA, 516 bp, Homo sapiens
  misc_feature: GYAE6OF02HZACW.19.71.G05.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (402)..(402): a, c, t, g, unknown or other
  misc_feature (402)..(402): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttacnggcatctaccgggaatccggggcctgaccgattcagtgcagcgggtctgggacagatttcactctcacatcagcagcctgcaggctagaantggtgctagttttattattgtaccaaactaagttattaattatacttacgttgacgtttcggacctaagggacctaagggtcgaattagtacgaggacgaacttggtgctgacc

SEQ ID NO: 278831 - DNA, 511 bp, Homo sapiens
  misc_feature: GYAE6OF02FZXWA.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgagatgtgctagtttatattgtcaactaattattattatacttcgtggtacgttcggaccgtaagggacccaaggtggaatatacgagacgaactggtggctgacc

SEQ ID NO: 278832 - DNA, 512 bp, Homo sapiens
  misc_feature: GYAE6OF02HDNQZ.19.71.G05.1.454.CMB.1.raw
  modified_base (238)..(238): a, c, t, g, unknown or other
  misc_feature (238)..(238): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactggcatctacccgggatccgggtcctgaccgatcagtgcagcgggtctgggacagatttcactctcaccatcagcagcctgcaggctgaagntgtgctagtttatattgtacaanaattattattaatacttgtgtacgttcggactaacgggaccaaggttcggaatagtacaaggacgtaacgtggtacggtctagcc

SEQ ID NO: 278833 - DNA, 588 bp, Homo sapiens
  misc_feature: GYAE6OF02JR5HT.19.71.G05.1.454.CMB.1.raw
  modified_base (237)..(237): a, c, t, g, unknown or other
  misc_feature (237)..(237): n is a, c, g, or t
  modified_base (317)..(317): a, c, t, g, unknown or other
  misc_feature (317)..(317): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctccaggctagctcgtatttacgngggctactccgtaaccccgggaagttcccggggtccctaggaacccgtattccgaggtcggccgtaaggccggggttctacggggactagtactttcgacctcctacaccatcgaagctacgcctgccaggcttagaagtagtgtagtacttaagttttattattagtaccaaacttaattatttaatttatacttcgttagtacgttcggactaacgggacctaaggtgtaactatacgaacgtacgaacgttggtacggtcgtagtacc

SEQ ID NO: 278834 - DNA, 498 bp, Homo sapiens
  misc_feature: GYAE6OF02GI4VJ.19.71.G05.1.454.CMB.1.raw
  modified_base (491)..(491): a, c, t, g, unknown or other
  misc_feature (491)..(491): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccggaatccggggtccctgaccgattcagtgcagcgggtctgggacagatttcactctcaccatcagcagcctgcagctgaagatgtggcagtttattattgtcaactaatattattaatacttcgtgacgttcgcctaagggaccaaggtgatatcagacgaactgnggtctgc

SEQ ID NO: 278835 - DNA, 548 bp, Homo sapiens
  misc_feature: GYAE6OF02IEFMQ.19.71.G05.1.454.CMB.1.raw
  modified_base (237)..(237): a, c, t, g, unknown or other
  misc_feature (237)..(237): n is a, c, g, or t
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctaccgggaatccggggtccctgacgattcagtggcagcgggtctgggacagatttcactctcacccatcagcagcctgcaggctagaagntgtgctagtttatattgtacaactaattattattaatacttcgtaggtacgtttcggacccgtaaggggtacccaagggttaggaacttagtaccgtaaggtaaccggaaacgttggttacgggtaccttggtaacccg

SEQ ID NO: 278836 - DNA, 516 bp, Homo sapiens
  misc_feature: GYAE6OF02JE6YU.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttactggcatctacccgggaatccggggtccctgaccgattcagtggcagcggtctgggacagatttcactctcacatcagcagcctgcagctgaagatgtgctagtttattattgtacaacaattattaattattacttcgtaggtacgttacggactaagggtacctaaggttggaatagtacgagacgtaacgtgtaggcttagacc

SEQ ID NO: 278837 - DNA, 507 bp, Homo sapiens
  misc_feature: GYAE6OF02I0TL1.19.71.G05.1.454.CMB.1.raw
  modified_base (237)..(237): a, c, t, g, unknown or other
  misc_feature (237)..(237): n is a, c, g, or t
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaccagcagagaccaggacagcctcctaggctgctcattactgggcatctacccgggaatccggggtccctgaccgattcagtgcagcgggtctgggacagatttcactctcaccatcagcagcctgcaggctgaagntgtgctagtttatattgtacaactaattattaatttatacttcgtgtacgttcgacgaagggccgtaaggtgtatatcgagacgaactgtcggctgacc

SEQ ID NO: 278838 - DNA, 342 bp, Homo sapiens
  misc_feature: GYAE6OF02IYEU0.19.71.G05.1.454.CMB.1.raw
  modified_base (338)..(342): a, c, t, g, unknown or other
  misc_feature (338)..(342): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttctcccagcccccatagacatgccacctcgtctctggtgctatattggggccagggaacccatgtcaccgtctcctcggcctccaccaagggcccatcggtcttcccctggcgccctgctccaggagcacctccgagagcacagcggccctgggctgcctggtcaaggctacttcccacgagagtactgagcgggctggcaaggcgcatagnnnnn

SEQ ID NO: 278839 - DNA, 507 bp, Homo sapiens
  misc_feature: GYAE6OF02F8HOM.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctggagatgtggctagtttattattgtcaacaattattaattatactttcgtgacgttcggccaagggaccaaggtggatagtcagacgaactggtggctgacc

SEQ ID NO: 278840 - DNA, 606 bp, Homo sapiens
  misc_feature: GYAE6OF02GRX87.19.71.G05.1.454.CMB.1.raw
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctctgggcagcgggccacatcaactgcaagtccagccacaatctttanacagttccaacatgaaactcttagcttgtaccagcagacgaccaggacagtcctctaggctgctcatttcgnggctatcgtaccggatccgggtcctgaccgtatcgagtcgcagcggtcnggacagtactttcacgtctacgactagtcgagtccgtaagtcccgtggaccagggtaccttaggaacgtacgttacggtacggtacttaacgtttattacgttacgtactaaacgttaacgttactttacgtttaacgtcgtttaccggttaggtaccgtttacgggaccgtaacggggtaccctaagggttacgaacgttaacgtaccggtaaggtaccggtaacttacgggtcgtaccgtaggtaacccg

SEQ ID NO: 278841 - DNA, 588 bp, Homo sapiens
  misc_feature: GYAE6OF02G2SL7.19.71.G05.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaattcttttanacagttccaacaatagaaaactacttagcttggtaccagcagagacagacagcctcctagctgctcatttacnggcatccgtaccgggaatcccggggtccctgaccgattcagtgcagcggtctgggacagtatttcgactctaccaccatcagcagcctcgcgacggctgaaacgtagtggtggacttaaggttttattagttacggtacaaacgttaattaatttaatttaacttacttaccggttagtaacccgggtttccggaccgtaaacggggtaaccttaaagggtggtaacttacgtacgaacggtaaccgtaacgttcggtacggtacgtacgtaacccg

SEQ ID NO: 278842 - DNA, 438 bp, Homo sapiens
  misc_feature: GYAE6OF02ILDKZ.19.71.G05.1.454.CMB.1.raw
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (421)..(421): a, c, t, g, unknown or other
  misc_feature (421)..(421): n is a, c, g, or t
  modified_base (427)..(438): a, c, t, g, unknown or other
  misc_feature (427)..(438): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaacccatgtcaccgtctcctcggcctccaccaagggcccatcggtcttcccccnggccgccctgctcaggagcacctcganagcacagccgccctgggctgcctggtcaaggacctactcccagagagtctgagcgggctggcaggcncatagnnnnnnnnnnnn

SEQ ID NO: 278843 - DNA, 495 bp, Homo sapiens
  misc_feature: GYAE6OF02JEJ9W.19.71.G05.1.454.CMB.1.raw
  modified_base (237)..(237): a, c, t, g, unknown or other
  misc_feature (237)..(237): n is a, c, g, or t
  modified_base (425)..(425): a, c, t, g, unknown or other
  misc_feature (425)..(425): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaactacttagcttggtaccagcagagaccaggacagcctcctaggctgctcatttactgggcatctaccgggaatccggggtcctgaccgattcagtggcagcggtctgggacagatttcactctcaccatcagcagcctgcaggctgagatgtgctagtttatatgtcaanatattattatacttcgtgtacgtcgacgaaggtaccgtaaggtcgatatcgagacgtaactgtgctgtac

SEQ ID NO: 278844 - DNA, 608 bp, Homo sapiens
  misc_feature: GYAE6OF02GWWZ2.19.71.G05.1.454.CMB.1.raw
  modified_base (238)..(238): a, c, t, g, unknown or other
  misc_feature (238)..(238): n is a, c, g, or t
  modified_base (369)..(369): a, c, t, g, unknown or other
  misc_feature (369)..(369): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaatctttanacagttccaaacaatagaaaactacttagcttggtaccagcagagaccaggacagcctcctaggctgctcatttactgggcatcgtacccgggaatccggggtcctagaccgattcgagtggcaggcggtntgggacagtactttcgactctaccactatcagcagccctgaccaggtctagaagtattggtggtacttaagttttattagttacgtacaaacttaattaatttaattaacttacgttacggttacgggtaaccgtttcgggaaccgtaaacggggtaaccctaaaggggttacgggtaacttaaacgttacgtaaacggtaaccggtaaacggttggtacgggtacgtacggtaacccg

SEQ ID NO: 278845 - DNA, 498 bp, Homo sapiens
  misc_feature: GYAE6OF02F1KTI.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatgtccaacacgtgaatacaaattatgcacatctgttgagagtcgactgacaatcaacgtagacacatacgaagaaccagttactccctgcagatcgactctgtcgacctaccgaggacgacggttagtactattacgtgtacggaagacggccccgtagtacgtac

SEQ ID NO: 278846 - DNA, 555 bp, Homo sapiens
  misc_feature: GYAE6OF02I4KU8.19.71.G05.1.454.CMB.1.raw
  modified_base (237)..(237): a, c, t, g, unknown or other
  misc_feature (237)..(237): n is a, c, g, or t
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtgctagtttattattgtacaacgtaattactttattaactactttcggtaggtacgtttcggacccgtaaaggggccctaaagggttcggtaagttacgttaccgaaggtaccggtaaacgttggtacggtcgttggtaacccg

SEQ ID NO: 278847 - DNA, 543 bp, Homo sapiens
  misc_feature: GYAE6OF02H9FWX.19.71.G05.1.454.CMB.1.raw
  modified_base (236)..(236): a, c, t, g, unknown or other
  misc_feature (236)..(236): n is a, c, g, or t
  modified_base (407)..(407): a, c, t, g, unknown or other
  misc_feature (407)..(407): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcacatcagcagcctgcaggctgaagntgtggctagtttattattgtacaaactaattattaatttatacttcgtgtacgtttcggaccgtaagggtccctaagggttggaattacgtacgaacggtaaccggtaaaccgttgggtacggtccgtagtacccg

SEQ ID NO: 278848 - DNA, 534 bp, Homo sapiens
  misc_feature: GYAE6OF02G9GQU.19.71.G05.1.454.CMB.1.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggtaccagcagagaccaggacagccctcctaggctgctctatttacngggcatccgtaacccgggaatcccggggtcctagaccgattcagtggcaggcggtctgggacagtatttcactctcacatcacgcacgcctgcaggctagaagatgtggactagtttattattactacaaactaatatttattacttaccttgttacggacgttcgaccgaacgggaaccaggttgaatatacgagacgtactggtcggctagaccg

SEQ ID NO: 278849 - DNA, 504 bp, Homo sapiens
  misc_feature: GYAE6OF02II2QO.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggctggggaagacatattcatgtaccaacacgtgaatacaaatatgcaccatctgttgagagtcgactgacaatcaacgtagacacatcgaagaaccagttactcctgcagctcgacctctagtcgactcccgaggaccgacgggtcgtaagttacttacgtggtaggaacgacggaccccagtagaacg

SEQ ID NO: 278850 - DNA, 518 bp, Homo sapiens
  misc_feature: GYAE6OF02HHRPC.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcaggcgggtctgggacagatttcactctcaccatcagcagcctgcaggctagaagatgtgctagtttattattgtacaactaatattattatacttgtgtacgttcggacctaagggacctaaggtggtaatacgtacgagacgaacgtggtggtctgaccg

SEQ ID NO: 278851 - DNA, 537 bp, Homo sapiens
  misc_feature: GYAE6OF02GN969.19.71.G05.1.454.CMB.1.raw
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
tcagtactctcgtgcacgaccggtgctcgatttagtgtcgtcgcaagagagaggggggcgagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcacgacccctctcgctcacctgtcgccatctccggggacagagtcgctagcgacagtgttgcttggcacgtgggtcaggcacgtccccatccggagacggtctagagttggccgtgggaacggactagtagtttcaagttgtaccaacgacgtaggaatactaaattactgacacctatctgttgagagtcgtactagacaatacaacgtanacacatacgaanacctagttctccagctagcgtcgacgtcgtcgtcgaccgtccggacggacgtacggtagtactagttacgtggtaggaacgacggtaccccagtacg

SEQ ID NO: 278852 - DNA, 522 bp, Homo sapiens
  misc_feature: GYAE6OF02I2AQ8.19.71.G05.1.454.CMB.1.raw
  modified_base (244)..(244): a, c, t, g, unknown or other
  misc_feature (244)..(244): n is a, c, g, or t
  modified_base (318)..(318): a, c, t, g, unknown or other
  misc_feature (318)..(318): n is a, c, g, or t
  modified_base (415)..(415): a, c, t, g, unknown or other
  misc_feature (415)..(415): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacnggcatctacccgggaatccggggtccctgaccgattcagtcgcaggcggtctgggacagatttcactctcaccatcagcagcctgcaggctagaagntgtggactagtttattattcgtactaacaattattattacttacgttcgtaggtacgttcggaccgtaagggtaccgaaggttggattagtacgacgtacgacgtgg

SEQ ID NO: 278853 - DNA, 540 bp, Homo sapiens
  misc_feature: GYAE6OF02GGEVU.19.71.G05.1.454.CMB.1.raw
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcaganaccaggacagcctcctaggctgctcatttacnggcatctacccggaacgtccggggtccctgaccgattcagtggcaggcgggtctgggacagtactttcactctcaccatccagcacgcctgcacggctagaagtagtgtcggtctaagttttattattgtacaactaattatttattattacgttcgtaggtacgttcgacgaagggtaaccgaaggttggaattagtcaaggacgtaatggtggtcgtagacccg

SEQ ID NO: 278854 - DNA, 512 bp, Homo sapiens
  misc_feature: GYAE6OF02G914C.19.71.G05.1.454.CMB.1.raw
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtgctagtttattattgtcaactattattattatacttcgtgtacgttcggaccgaagggccaaggtggaatatacgagtacggaactggtaggtctgacc

SEQ ID NO: 278855 - DNA, 558 bp, Homo sapiens
  misc_feature: GYAE6OF02HZGPL.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctacccgggaatccggggtcctgaccgattcgagtgcagcgggtctgggacagatttcactctcaccatcagcagcctgcaggctaggaagtgtggtgactaagttttattagtttagtactaaacgtaattatttaatttacttacgttcgttagggtaccgtttaccggaccgtaaacggggtaaccaagggttgaattacgtacgaggtaccgtaaacgttggtacggcttagaccc

SEQ ID NO: 278856 - DNA, 517 bp, Homo sapiens
  misc_feature: GYAE6OF02H7ZQ8.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggtaccagcagagaccaggacagcctccaggctgctcatttactgggcatctacccgggaatccggggtcctgaccgatcagtgcagcggtctgggacagatttcactctcaccatcagcagcctgcaggctagaagatggtggctagttttattagttgtacaaactaatatttaattatacttcgtggacgtttcggacctaaagggtaccaaggtgaatatacgaagtacgaatacgg

SEQ ID NO: 278857 - DNA, 532 bp, Homo sapiens
  misc_feature: GYAE6OF02IRC2Z.19.71.G05.1.454.CMB.1.raw
  modified_base (238)..(238): a, c, t, g, unknown or other
  misc_feature (238)..(238): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaaactacttagcttggtaccagcagagaccaggacagcctcctaggctgctcatttactgggcatctaacccgggaatccggggccctgaccgattcagtgcagcgggtctggganagatttcactctcaccatcagcagcctncaggcngaagatgtganagttttatagttgtacaaanaattaattaattattaacgttcgtgtaaccgttcgaccgaaacgggtacgaaacggttggaattaagtacaagacgtaacgtaggtgtcgtagacc

SEQ ID NO: 278858 - DNA, 643 bp, Homo sapiens
  misc_feature: GYAE6OF02HS3PY.19.71.G05.1.454.CMB.1.raw
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctggngngcggcgccacgcacancgatacncncacatactttnttacagtactacaatagaaactaacttatntcgtacacacacagacacgagacgactccgtacgacgtncgtctacttaacgttcggcgactacgtacccggaacggtaccggtcccggtcgacgacttactagnggtcgacggacggtcggtggtacgagtacgttttcaccgaccttccaccaacgttacacggactaaccgccgttcgacggaacggtacgttacgaaaggtaaccgttggttacgggtaccgttaagtttttaacgttttaattacggtcctaaaactaaaattattttaactttaacgttacgtttacggttacgggttaacgttaccggtaccgaaacgggttaaccggtacggttaagggattaactccggaacgtacggaacttggg

SEQ ID NO: 278859 - DNA, 505 bp, Homo sapiens
  misc_feature: GYAE6OF02FW1R2.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaactaatattattatacttcgtgacgttcggacaagggaccaaggtggaatatcagacgtaactggtggctgtaccg

SEQ ID NO: 278860 - DNA, 501 bp, Homo sapiens
  misc_feature: GYAE6OF02G04JN.19.71.G05.1.454.CMB.1.raw
  modified_base (237)..(237): a, c, t, g, unknown or other
  misc_feature (237)..(237): n is a, c, g, or t
  modified_base (379)..(379): a, c, t, g, unknown or other
  misc_feature (379)..(379): n is a, c, g, or t
  modified_base (482)..(483): a, c, t, g, unknown or other
  misc_feature (482)..(483): n is a, c, g, or t
  modified_base (497)..(497): a, c, t, g, unknown or other
  misc_feature (497)..(497): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactgggcatctacccgggaatccggggtccctgaccgattcagtggcagcggtctggacagatttcactcncaccatcagcagcctgcaggctgaagatgtggctagtttattagttgtacaaactattattattatacttgtggtacgttgaccgaaggtaccaaggtgatannagacgtatgtgtcngacc

SEQ ID NO: 278861 - DNA, 511 bp, Homo sapiens
  misc_feature: GYAE6OF02IQ27M.19.71.G05.1.454.CMB.1.raw
  modified_base (238)..(238): a, c, t, g, unknown or other
  misc_feature (238)..(238): n is a, c, g, or t
  modified_base (419)..(419): a, c, t, g, unknown or other
  misc_feature (419)..(419): n is a, c, g, or t
  modified_base (503)..(503): a, c, t, g, unknown or other
  misc_feature (503)..(503): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttactgggcatctacccgggaatcccggggtccctgaccgattcagtggcaggcgggtctgggacagatttcactctccaccatcagcagccctgccaggctagagatgngctagtttattattgtacaataatattattaatacttcgtgtacgttcgaccgtaagggaccaaggtgatagtacagacgatgnggctgacc

SEQ ID NO: 278862 - DNA, 524 bp, Homo sapiens
  misc_feature: GYAE6OF02HEEIX.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacngggcatctacccgggaatccggggtccctgaccgattcagtggcagcggtctgggacagtatttcactctcaccatcagcagcctgcgagctgaagatgtgctagtttattattagtactaaataattattaatttatacttcgtagtacgttcgacgtaagggtaccgtaaggtggaattacgtacgagtacgaacgtggtacggctgacc

SEQ ID NO: 278863 - DNA, 553 bp, Homo sapiens
  misc_feature: GYAE6OF02H9BH2.19.71.G05.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgagcggncgggccaacgctcaactagcagtcagccanatctttanacagttccaacaatgaaaactctagcttggaccagcagagacaggacagcctcctaggctgctcattacgngcatcgaccggacgtccggtcctgactntcgagtcgacgnggtcgtacgtggactagtcttcactcacacntcancacgcgcgcgcgacgtacgagagtgtagtacgttagttattagttagtactaactaattaattaattacttacgttacgttacggtacggttaccggtacggtaacggtaacggtaacggtaacgtacgtacgtacgtaacggtaacgtaacgtacggtacggtacgtacg

SEQ ID NO: 278864 - DNA, 523 bp, Homo sapiens
  misc_feature: GYAE6OF02HOYY8.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaatcttttanacagttccaacaatagaaaactacttagcttggtaccagcagagaccaggacagcctcctaggctgttcatttactgggcatcgtacccgggaatccggggtccctgaccgattcgagtggcaggcgggtctgggacagatttcactctcaccatcagcacgctgcaggctgaagatggtgctagtttattattgtacaactaatattattatacttgtggtacgttcggacgaagggtaccgtaaggtagatatacgaagacgtaacgtgtaggtctgactac

SEQ ID NO: 278865 - DNA, 738 bp, Homo sapiens
  misc_feature: GYAE6OF02J3T2M.19.71.G05.1.454.CMB.1.raw
  modified_base (323)..(323): a, c, t, g, unknown or other
  misc_feature (323)..(323): n is a, c, g, or t
  modified_base (355)..(355): a, c, t, g, unknown or other
  misc_feature (355)..(355): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtcctccagtacctccctggcctggtgtcctcgtgggccgaggccggaccaccatcaactgaccaacgtccacgccaactaacttcttttacactacgttaccaaacaatacgtaaactcgttagccgttacggaccagacaagacgacctaggacncgtcctacgtaggctcgcttacgtacttacgnggacctacgtacccggtaaccggtacggttccccggggtacctacggtaaccgttcgttaccggtaacggggtccggtaccggtaacggggttccggggttaacccgttaacgggggtaaacccttacggtttaaacccttttccgaaccccgttttacctaacccggaaccttacgttacccggaaacggtcccgtaacgggtttcccgtagggaaccgtacgggtaaccgtaaggtaaaccggttagttcggttacggtatttaacgtttattacgtaacgtactaaatactttagttacgtactcggtcgtacgaccggttcgacggtaacgtagaggtataacctagacgaacgtacgtagtcgaccgtatacctaacg

SEQ ID NO: 278866 - DNA, 504 bp, Homo sapiens
  misc_feature: GYAE6OF02ISPFQ.19.71.G05.1.454.CMB.1.raw
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaantgtgctagtttatattgtcaacaattattattatacttcgtgtacgttcggacaagggaccaaggtggatagtcgagacgaactggtggctgacc

SEQ ID NO: 278867 - DNA, 532 bp, Homo sapiens
  misc_feature: GYAE6OF02GUIRB.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttaggtaccagcagagaccaggacagcctcctaggctgctcatttactggcatctacccgggaatccggggtcctgaccattcagtgcagcgggtctgggacagtatttcactctcaccatcagcagcctgcaggctagaagtatgtgctagtttattattcgtacaactaattatttaattactacgttgtaggtacgttcggaccgtaagggaccctaaggtggtataacgtacgacggtaacgtaacgtggtacggtctagacc

SEQ ID NO: 278868 - DNA, 500 bp, Homo sapiens
  misc_feature: GYAE6OF02GONVL.19.71.G05.1.454.CMB.1.raw
  modified_base (239)..(239): a, c, t, g, unknown or other
  misc_feature (239)..(239): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggggaggtacaacaggcaggcaggggcagcaaggatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctaccgggaatccgggtcctgaccgattcagtgcagcggtctggacagatttcactctcaccatcagcagcctgcaggcngaagntgngctagtttattatgtacaacattattatatacttcgtgtacgtcgaccaagggctaaggtagatatgacgacgtaactggtaggctgtaccg

SEQ ID NO: 278869 - DNA, 510 bp, Homo sapiens
  misc_feature: GYAE6OF02I0YGO.19.71.G05.1.454.CMB.1.raw
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
  modified_base (491)..(491): a, c, t, g, unknown or other
  misc_feature (491)..(491): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtggctagtttattattgtacaaactaattattaattatacttcgtgtacgttcggacaagggaccaaggtggaatatanagacgaatgtaggctgacc

SEQ ID NO: 278870 - DNA, 504 bp, Homo sapiens
  misc_feature: GYAE6OF02FS944.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcattactgggcatctacccgggaatccggggtccctgaccgattcagtggcagcgggtctgggacagatttcactctcaccatcagcagcctgcaggctgaagatgtggcagtttattattgtcaactaatattattatacttcgtgtacgttcggcctaagggaccaaggtggatatcgagacgaactggtggctgcc

SEQ ID NO: 278871 - DNA, 572 bp, Homo sapiens
  misc_feature: GYAE6OF02IXOPR.19.71.G05.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaaacaatagaaaactacttagcttaggtaccagcagagaccaaggacagcctctagctgctcatttacngggcataccgtaccggaagtccggggtcctgaccgtattcgagtggacaggcgggtctagggacagtactttcactctcacatcagcagcctgctaggctagaagatgacggtctagtttatattagtactaaactaattaatttaattacttacttcggttaggtacgttcgggaaccgtaacgggtaaccgaagggttacggtaattacgtaacgacggtaacggaacgttcggtacggtaccgttgaacccg

SEQ ID NO: 278872 - DNA, 513 bp, Homo sapiens
  misc_feature: GYAE6OF02I5YVM.19.71.G05.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttacnggcatctaccgggaatccgggtcctgaccgatcagtgcagcggtctgggacagatttcactctcacatcagcagctgcagctgagatgtggctagtttattagttgtacaactaattattattattacttgtagtacgttcgaccgtaagggacctaagggtcggaatagtcgacgacggaaacgttgtacggtctgtaccg

SEQ ID NO: 278873 - DNA, 505 bp, Homo sapiens
  misc_feature: GYAE6OF02GO848.19.71.G05.1.454.CMB.1.raw
tcagtactctcgtgcacgaccggtgctcgatttagtgtcgtcgcaagagagaggggggaggtacaacaggcaggcaggggcagcaaggtggtgttgcagacccaggtcttcatttctctgttgctctggatctctggtgcccacggggacatcgtgatgaccccagtctccagactccctggctgtgtctctgggcgagcgggccaccatcaactgcaagtccagccacaatcttttatacagttccaacaatgaaaaactacttagcttggtaccagcagagaccaggacagcctctagctgctcatttactgggcatctacccgggaatccgggtccctgaccgattcagtgcagcgggtctgggacagatttcactctcacatcagcagcctgccaggctagaagatgtggctagttttatattgtacaaacaatattattaatacttcgtaggacttcggacaagggaccaaggtgatatcagacgactgtgctgactacg

SEQ ID NO: 278874 - DNA, 715 bp, Homo sapiens
  misc_feature: GYAE6OF02H60W8.19.71.G05.1.454.CMB.1.raw
  modified_base (250)..(250): a, c, t, g, unknown or other
  misc_feature (250)..(250): n is a, c, g, or t
  modified_base (344)..(344): a, c, t, g, unknown or other
  misc_feature (344)..(344): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatacaactcgacaacgtccaagaccaactaattcttttaanactagttaccaacaaatacgaaaacttacgttagtacttacggaaccagcaagacgaaccaggaccagcctacgtaggctgctactatttacgnggactacgttaccgaaccgggtaacgttcccgggggtaccctacgggaaccggtacggttcccggggggacctaacggggtccggggttacgttacggggaacctaaggttaccttttaccgaactttcccgtaccaaccgtactaccgagaccgacgtccgtaggaccgaacgggtctaacggaaagtgttacgggtacggtactttaaaggttttactacgttgtactaagtacttaaattttctttttactaacttcccgttacggtacgggttaccgttacgggaccgtaacgggtaaccggtagggttaacgtaaacgtacgtaacggaacgtaacgttggtacggtacgtacgtaccctataacg

SEQ ID NO: 278875 - DNA, 532 bp, Homo sapiens
  misc_feature: GYAE6OF02FUACK.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagacgaccaggacagcctcgtaggctgctcattactggcatcgtacccggatccgggtcctgaccgattcagtgcagcgggtctgggacagtactttcactctacaccatcagcagcctgccaggtctagagtagtggtgactagtttattagttacgtacaactaattattaattactacgttcgtaggtacgttcggaccgtaagggaactaaggtcggtatacgtcgagtacgtacgtgtacggctgtacc

SEQ ID NO: 278876 - DNA, 514 bp, Homo sapiens
  misc_feature: GYAE6OF02GVDQ4.19.71.G05.1.454.CMB.1.raw
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (506)..(506): a, c, t, g, unknown or other
  misc_feature (506)..(506): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatcccggggtcctgaccgattcagtggcaggcgggtctgggacagntttcactctcaccatcagcanccctgcaggctgaagatgtgctagtttatattgtacaacaattattattatacttcgtaggtacgttcggacgtaagggcctaaggttggattagtcgagacgaactggnggctgacc

SEQ ID NO: 278877 - DNA, 537 bp, Homo sapiens
  misc_feature: GYAE6OF02GPQFZ.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatcccggggtcctgaccgattcagtcgcaggcgggtctgggacagatttcactctcacatcagcacgcctgccaggctagaagntggtgactagtttattattgtacaactaattatttattattacgttcgtaggtacgttcgacgtaagggaccgtaagggtggtaatagtacgtaggtacgtaacttggtacggtcctagtaccg

SEQ ID NO: 278878 - DNA, 502 bp, Homo sapiens
  misc_feature: GYAE6OF02G57HP.19.71.G05.1.454.CMB.1.raw
  modified_base (238)..(238): a, c, t, g, unknown or other
  misc_feature (238)..(238): n is a, c, g, or t
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcagctgaagntgtgctagtttattattgtcaataattattattatacttcgtgtacgttcgccaagggccaaggtgagtatcgagacgaacgtgtggctgacc

SEQ ID NO: 278879 - DNA, 519 bp, Homo sapiens
  misc_feature: GYAE6OF02GHQK4.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatcgtacccgggaatcccggggtccngaccgattcagtggcaggcgggtctgggacagatttcnctctcacancagcacgctgcaggctagagntgngctagtttatattgacaataatattaattattacgttagtagtaccgttcgaccgtaagggtaacaaggttgattacgtcgaagacggtactggtgtacgtgtacc

SEQ ID NO: 278880 - DNA, 534 bp, Homo sapiens
  misc_feature: GYAE6OF02HCACF.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagaccccctggctgtgtctctgggcgagcgggccaccatcaactgcaagtccagccacaatcttttanacagttccaacaatagaaaactacttagcttaggtaccagcagagaccaggacagcctctaggctgctcatttacnggcatcgtacccggatccgggtcctgaccgattcagtgcagcggtctgggacagtatttcactcncacatcagcagcctgcaggctgaagtntgtgctagtttatattgtacaatattattattatacttcgtaggtacgttacggacgtaacgggtaccgaagggtcgtaattacgtacgaaggtaaccgaacgttggtacggtacttacgcctaaccg

SEQ ID NO: 278881 - DNA, 505 bp, Homo sapiens
  misc_feature: GYAE6OF02HYIUP.19.71.G05.1.454.CMB.1.raw
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagacaggacagcctccgtaggctgctcatttacnggcatccgtacccgggaatccggggtcctgacccgattcgagtgcagcggtctgggacagactttcactctcacatcagcagcctgcagctgaagntggtgactagtttatattgtacaaactaatattatattactgtagcgttcgacaaggtaccaaggtggatagtacaacgacgtaagtcg

SEQ ID NO: 278882 - DNA, 599 bp, Homo sapiens
  misc_feature: GYAE6OF02H8MAE.19.71.G05.1.454.CMB.1.raw
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccaacaattcttttaanacagttaccaacaaattgaaaaactacttagcttggtaccagcagagaaccaggacagcctacctaggctgctcaattttacgnggctactcgtaccggacgtccgggtcctagacgtatcgagtcggcgacggtcgggtctagggactagtactttccactctaccaccatacgagcacgtcctgacgaggctaagaagtgtggtcgtacttaagtttattaattcgtaactaaactaatttaatttaattaacgtacgttacggtagtaccgttaccggaccgtaacgggtacctaagggttagtaacttaacgtactaacggtaacgtaacgttggtacgtaccgtagtacc

SEQ ID NO: 278883 - DNA, 552 bp, Homo sapiens
  misc_feature: GYAE6OF02HU5YR.19.71.G05.1.454.CMB.1.raw
  modified_base (239)..(239): a, c, t, g, unknown or other
  misc_feature (239)..(239): n is a, c, g, or t
  modified_base (418)..(418): a, c, t, g, unknown or other
  misc_feature (418)..(418): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatagaaaactacttagcttggtaccagcagagaccaggacagcctcctaggctgctcatttactgggcatccgtacccgggaatcccggggtccctgaccgattcagtggcgaggcgggtctgggacagtatttcactctcaccatcagcagcctgcagctagaagntgtggctagtttattattgtacaactaattattattatacttcggtacgtacgtttcggaccgtaagggtacctaagggttggtaattagtacgaaggtaaccggtaacgttcgggtacggtccgtagtacccg

SEQ ID NO: 278884 - DNA, 718 bp, Homo sapiens
  misc_feature: GYAE6OF02HX47E.19.71.G05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttatctgttgctctggatctctggtgcccacggggacatcgtgatgacccagtctccagacctccctggctgtgtctctgggcgagcgggccaccgatcaactgcaagtccagccacaattctttanacagttccaacaatagaaaactcttagcttaggtaccagcagacgacaggacagcctccgtaggctgctcattttacgngggacacgtaccgtacccggggaattcccggggtaccctggacccgattaccaggtcggcagggtccgggtctgggaactaggtacttttcgaccttcgtaccaaccgtattaccgaagccgtacgtccgttcggaccgtacgggtaccttagggaaaagtcggttcgggttacggtaccgttaaggttttttaagtttaaacgtttacggttaaccctaaaactttaaagttttaacgttttaacgtttaaaccgtttaaccgtttaaccgggttttacgggtacccgggttttacccggaacccggttaaacggggtaaacccgtaaaggggttcgtaaacgttaacgttacgaacgggtaaccggtaaacgttcggggtacgtccgtagtaacccg

SEQ ID NO: 278885 - DNA, 585 bp, Homo sapiens
  misc_feature: GYAE6OF02G28L1.19.71.G05.1.454.CMB.1.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatacaactgacaagtccagccanatctttanacagttccaacaatgaaaactacttagcttggtaaccagcagaacgaccgaggacagcctcctaggctgcctactatttacngggctagtccgtaacccggggaatcccggggtcctagaccgtattcgagtggcaggcgggtctagggacaggtatttcactctctaccatcagcacgcctgcgaggctaggaaagtgttgtggacttagttttaattattacggtacaaacgtaattatttaacttaattacttacggtagtaccggtttacggaccggaaacgggtaaccgtaacgggtaggtaatacgtacgaacggaccggtaagttcggtagggctagaccc

SEQ ID NO: 278886 - DNA, 750 bp, Homo sapiens
  misc_feature: GYAE6OF02IE4FO.19.71.G05.1.454.CMB.1.raw
tcagtactctcgtgcacgaccggtgctcgatttagtgtcgtcgcaagagagaggtctagggagtcggcgtgggaaggacatatttcagtgtccaacacgtggaatacaaagttatgcaccaatcctgttcgtacgagtcgactggacaatcgaacgtaggaccacatcgaagaaccacgttctccctgcaggctgactctgtgactcccggaggacacgggtgtactattactgttcggaagaggccccagtacgacatgccacctcggttcttctggtcgtctattacgttcggggaccaagggaacccactcggtacccaacccggtaccttacccgtccgggtacccttaccgaaccgtaaacggggggcccctaagttacccggggtttcccgttttccccccgtcgggtaccgtaccccgttcggtcccttacccgaacgggtaacgccgtaacccgttccggtaacggaacggtccaaaccgacggtcccggaccccgttggggaccctcgggtaccccgttcggtaaccaaacgggtacccttaaccgtttccccgaaaccgtacggtaacgttaaccgtacgggtaacggtccggggtacctttaacgggtacctaaaggggtaccgtaccgtaaacggttaacgtagtacgacgctaacgtctagtacgtcggacggcgtacgacgtagtcgacgtcggacgtacacgtacgacgctacggtccctggtactcgtacgtcg

SEQ ID NO: 278887 - DNA, 826 bp, Homo sapiens
  misc_feature: GYAE6OF02IQYGP.19.71.G05.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtcgtcgcaagagagaggggggaggtacaacaggcaggcgaggggcagcaagatggtgttgcagacccaggtcttcatttctctgttgctctggatctctggtcgcccgacggggacatcgtgatcgacccagtcctccagacctcccgtggctgtgtctcgtgggcgacggccggccaccatcaactcgacacgtccagccaactaattccttttaanacgtacgttaccaaaactaagtaacgaaaaaccttacttaagtccgttacggtaacccaggaccaaggaaccgaaccgaacgggaaccacggtccccttaccggtagggcctcgacctacttaacgttttacgcggggacctacgttacccggtaacccggggtaaacggttcccccgggggttcccacgggtaacccgttacgttccgaagggttcgggacgtaacggggtccgggttacgtacgggggaacctaggttactttttccgacttcctaccgaacctacgtaccgacggtactaccggtccctgggaccgtaacgggtccgtaagggtaaacgtacggttacgggtacggaacgttttaggtttttaaacgttacggttttaccggtaaacctaaaaactttaaagttaacttttaaactttaacgttaaccgtttcggttacgggttaacccggttacgggaacccggtaaacgggtaacccgtaaggggttaacgtaacttaaccgttacggaacggtaaccggttaaacgttccggggtacggtaccctaggtaccccg

SEQ ID NO: 278888 - DNA, 542 bp, Homo sapiens
  misc_feature: GYAE6OF02HRWZE.19.71.G05.1.454.CMB.1.raw
  modified_base (238)..(238): a, c, t, g, unknown or other
  misc_feature (238)..(238): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatcctaccgggaatccggggtccctgaccgatcagtgcagcggtcnggacagattcactcncacatcagcagcctgcaggctaggaagatgtggactaggtttattattagtactaaactaattattaatttatacgtttcgtaggtacgttcggaccgtaagggtaccgaaggttggattaacgtacgaacggtaacgaaacgttggtaggaccgtagaacccg

SEQ ID NO: 278889 - DNA, 530 bp, Homo sapiens
  misc_feature: GYAE6OF02JHEEB.19.71.G05.1.454.CMB.1.raw
  modified_base (238)..(238): a, c, t, g, unknown or other
  misc_feature (238)..(238): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttactgggcatccgtacccgggaatcccggggtccctgaccgattcagtggcagcgggtctgggacagtatttcactctcaccntcancagctgcaggctagaagtntgtggctagttttatattgactaaactaattatttattattacttcgtaggtacgttcgacgaagggtaccgaaggtggtactagtacgagacgtaacgtggtaggtcctgacc

SEQ ID NO: 278890 - DNA, 510 bp, Homo sapiens
  misc_feature: GYAE6OF02GST84.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatcccggggtcctgaccgattcagtggcagcgggtctgggacagatttcactctcaccatcagcagcctgcaggctgaagatgtcggctagtttattattgtacaactaattattattatacttcgtgtacgttcggacgaagggaccaaggttgatagtacagacgaactggtggctgacc

SEQ ID NO: 278891 - DNA, 501 bp, Homo sapiens
  misc_feature: GYAE6OF02FUQ3J.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtgctagtttattattgtcaacaatattattatacttgtgtacgttcggccaagggccaaggtggatatcagacgaacgtgtggctgacc

SEQ ID NO: 278892 - DNA, 537 bp, Homo sapiens
  misc_feature: GYAE6OF02IACWM.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaatcttttanacagttccaacaatagaaaactacttagcttggtaccagcagagaccaggacagcctcctaggctgctcatttacgngggcactcgtacccgggaatcccggggtccctgaccgtattcgagtcggcaggcgggtctggggacagtattttcactctcaccatcagcacgcctgcgaggctaggaagagtggtggctaagtttatttattgtacaaactaattattattactagttcgtagtacgttcggactaagggaccgaaggtgaatatacgaagacgtaagtggtgactgaccg

SEQ ID NO: 278893 - DNA, 505 bp, Homo sapiens
  misc_feature: GYAE6OF02G5D6I.19.71.G05.1.454.CMB.1.raw
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctgcagaccctctcgctcacctgtgccatctccggggacagagtcgctagcgacagtgttgcttggcacgtgggtcaggcagtccccatcgagaggtctagagtggcgtgggaaggacatattcatgtccaacacgtaggaatacaaattatgacacatctgttagagagtcgactgaacatcaacgtagacacatacgaacgaccagttcctcctagccagctcgacctctagtcgaccgtccggacggcgacggtntatacgttacgngtaggacgaccgaccctagtagaccg

SEQ ID NO: 278894 - DNA, 566 bp, Homo sapiens
  misc_feature: GYAE6OF02HTHYB.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtccctgaccgattcgagtggcaggcgggtctgggacagatttcactctcacatcagcagcctgcaggctagaagatgtggctagttttattagttgtacaactaattagtttattaatactttcgtaggtaccgtttcggaccgtaaacggggtacctaaaggggttggtaacttaacgtaccgtaaggtaaccggtaaaccgttgggtacggtaccttaggaaccccg

SEQ ID NO: 278895 - DNA, 580 bp, Homo sapiens
  misc_feature: GYAE6OF02J2C6E.19.71.G05.1.454.CMB.1.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
  modified_base (410)..(410): a, c, t, g, unknown or other
  misc_feature (410)..(410): n is a, c, g, or t
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagtactctcgtgcacgaccggtgctcgatttagtgtcgtcgcaagagagagggggtcgaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanaccagttccaacaatagaaaacctacttagcttcggtaccagcaganaccaggacacgcctccgtaggcttgacctctaacgtttactggggaccataccgtaccccggggaagttccccggggtcctacggaacccgtattccaggtcggcagggccgggttcngggacagtctttcactcgtcacgtatcagcagcctgctaggctaganttggcgctagtttattnttgacctaaagtattagttattacgtcgttcggtcgggtacgtccggtaacgtaacgggtaacccgtaagggtcgtaacagttaccgaggtaaccgtattacgggg

SEQ ID NO: 278896 - DNA, 517 bp, Homo sapiens
  misc_feature: GYAE6OF02GLG9W.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctggggacagatttcactctcacatcagcagcctgcaggctgaagatgtgctagtttattattgtacaaactaattattattatacttcgtgtacgttcggaccaagggaccaaggttggaattagtacgagacgtaactggtcggtctgacc

SEQ ID NO: 278897 - DNA, 519 bp, Homo sapiens
  misc_feature: GYAE6OF02JDHSX.19.71.G05.1.454.CMB.1.raw
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagagtctagagtggctgggaaggacagtatttcatgtaccaaacgacgtaggaactacaaatttatcgcaaccatctgttagagagtcgactagacaatctaaacgtagacacatacgaacgaacctagttctaccctgacagtactagtaacctctagtcacgtacccgaaggactacgggtagtatagtactggtaggaagcggacccctagtaacg

SEQ ID NO: 278898 - DNA, 659 bp, Homo sapiens
  misc_feature: GYAE6OF02H43BM.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtgccatctccggggacagagtcgctagcgacgagtgttgcttggcacgtgggtcaggcacgtcccatcgagaggtctaggagtggcgtaggggaacggactattatttcgaagttcgtacccaaacgtacggtaggtaaaacttaaccgtaaaatttacgtacggtacctaacccgtaagtttccgtttaagggtttaggaaagggtaacgttaccgtaacttacgggaacctaaattaccgaaacgttaagaacctacgtaagtaaccggaaaacgtaaacccgtacgtttacctaccccgtagaccaacggttcctacggaacccttcgtacgtacgacccgtccccgggaagggacccgtacgggttagtaacttaacgttacgtggtacgggtaacgacccggtaccctaagtacgtaaccg

SEQ ID NO: 278899 - DNA, 1029 bp, Homo sapiens
  misc_feature: GYAE6OF02II4RB.19.71.G05.1.454.CMB.1.raw
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctctgggcgagcgggccacatcaactgacaagtccagccaactaattcttttaatacacgttaccaaacaatagaaaactacttagcttaggtaccagcagagaccaggacacgcctccgtaggctgctactatttacgngggactacgtccgtaacccggggtaacgtcccgggggtccctacggtaaccgtacttacgaacggttcgggacgtacgggtccgggggttacgttacgggggtaaaccgtaacggttaacgttttttacccgaacccgtttacccgttacccgtaaacccccgtaacttaccccgaaacgggacccgttaaaccgggtacccccggtttaacgggaccccgggttaaacgggggttaccccggtttaaaggggtaaaaaaccgggttaacgggtttttaccgggggttaacgggggtttaaaccccggtttttaaaagggttttttttttaaaaccggtttttaaacgttttttaaccgggttaaaacccccgttaaaaaaaccggtttaaaaacttttttaaaacgttttttttaaaaaccgtttttaaacggtttttaaaccccggttttttaaccgggggtttaaccggggggttttaaaccccgggtttaacccggggggtaaacccccggggttaaaaccgggggggtaaaaccccggtttaaaaacgggggggtttaaccggggttaaaacgttttaaacccggtttaaacccgggttaaaacgggggttaaaaccccggggttaaaaaccgggttttaccgggggttttaaaccgggggttacccccggttttaccgggtaaaacccccccggg

SEQ ID NO: 278900 - DNA, 497 bp, Homo sapiens
  misc_feature: GYAE6OF02F1AKQ.19.71.G05.1.454.CMB.1.raw
  modified_base (237)..(237): a, c, t, g, unknown or other
  misc_feature (237)..(237): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagctttggtaccagcagagaccaggacagcctcctaggctgctcatttactgggcatctacccgggaatcccggggtccctgaccgattcagtggcagcgggtctgggacagtatttcactctcaccatcagcagcctgcaggctgaacgatgtgctagtttattattgtacaataatattattatacttcgtgacgttcgcaagggacaaggtgatancagacgaatgngctgc

SEQ ID NO: 278901 - DNA, 709 bp, Homo sapiens
  misc_feature: GYAE6OF02HD7IB.19.71.G05.1.454.CMB.1.raw
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatgacccagtctccagacctcccgtggctgtgtctcgtgggcgagcgggccaccatcaactgcaagtccagccacaattcttttanacagttaccaaacaatagaaaaacttcttaagtcttacggtaaccagacaagacgaacccaggacacgcctccgtaggctgcctctatttacgnggactagtccgtaacccgggaatcccggggtccctaggaccgtattcgagtcggacaggccgggtactggggaactaggtacttttcgacctctacctaaccattaccagaccacggtccttcggaccgagggtcctaaggtaacgtagttcgggtcggtaaccttaaggtttttaacttagttacggttaaccaaaacgttaaatttaacgttttaaactttaaccgtttaaccggtttaccgggttacgggttaaccggtttaccggggaaccgtaaacggggtaacccggtaaggggttacggtaacttaacgttaaccgtaacggtaaccggttaaccgttcgggttaacggtaccgtacggtaacccg

SEQ ID NO: 278902 - DNA, 622 bp, Homo sapiens
  misc_feature: GYAE6OF02FE62R.19.71.G05.1.454.CMB.1.raw
  modified_base (256)..(256): a, c, t, g, unknown or other
  misc_feature (256)..(256): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagacctccctggcttgtgtctcgtgggcgagcgggccaccatcaactgcaagtccagccacattctttanacagtccaacaatagaaaactcttagcttggtaccagcaagacgaccaggacagccctcgtaggctgcctcattttacgggctagtccgtaacccgggaatcccggggtaccctgacccgtatttccgaggtcggacaggtccggggtcgtggggactaggtactttccgaccttcctaccaacccgataccgacgcacggtccctggccgaggtcctaaggaacgattagggtaggtacgttaagtttttacgttaatttcgtaactaaaccgttaatttattaatttacgtttaaccgttcgtacgggtaccgtttacggaaccgtaacgggaccctaagggttgtaacgtagtaccgtaacgg

SEQ ID NO: 278903 - DNA, 552 bp, Homo sapiens
  misc_feature: GYAE6OF02IMWJH.19.71.G05.1.454.CMB.1.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacatcactgacaagtcagccacatctttanacagtcaacatagaaaactntagctggtaccagcagacaccaggacagcctaccgtaggctgctcaatttacgnggctatccaccgggatccggggtcctagaccgtnttcgagtgcaggcggtctgggacngtacttcactctcacatcagcagcctgcctagctagaangtgtgactagtttattgttacgaactaataattactttaagttacttaacttcggtagtaaccgttcggaaccgtaagggtaaccctaagggttagtaacgttactacgtaacggaaccgtacgttaggtacggtcctacggaacc

SEQ ID NO: 278904 - DNA, 543 bp, Homo sapiens
  misc_feature: GYAE6OF02GPZA8.19.71.G05.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (417)..(417): a, c, t, g, unknown or other
  misc_feature (417)..(417): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaccagcagagaccaggacagcctcctaggctgctcatttacnggcatctacccgggatccggggtcctgaccgattcagtggcaggcgggtctggggacaggtactttcgacctctacacccatcagcagcctgcaggctagaagntgtgctagtttatatgtacaactaatatttaattatacgttgtcggtacgttcggaccgtaagggtacccaaggttcggtaatacgttacgacggtaacggtaacgtgtacggtactcggtacccg

SEQ ID NO: 278905 - DNA, 696 bp, Homo sapiens
  misc_feature: GYAE6OF02J0JRQ.19.71.G05.1.454.CMB.1.raw
  modified_base (326)..(326): a, c, t, g, unknown or other
  misc_feature (326)..(326): n is a, c, g, or t
  modified_base (400)..(400): a, c, t, g, unknown or other
  misc_feature (400)..(400): n is a, c, g, or t
tcagtactctcgtgcacgaccggtgctcgatttagtgtcgtcgcaagagagaggggggagggtacgaacaggcaggcgaggggcgagcaagatggtgttgcagacccaggtcttcatttctctgttgctctggatctctggtgcccacggggacatcgtgatgacccagtctccagactccctggctgtgtctcgtgggcgaggccgggcccaccatccaactgcaagtccagccacaatcttttaactagttaccaacaatgaaaactacttagcttggaccagcagacgaccaggacagcctcctaaggctgcctcatttacgnggctactcgtacccgggaagtcccggggtaccctggaacccgtattccgaggtcggacgaggtccggggttcgnggggtaccgaggtacttttaccgacttccgtaccacctacgttaccaagccgaaccgtccttaggaccgtacgggtacttacggaaaggttcgttcgggtacgggtacctaaggttttttaacttacggttacggtaactaaaaccgttaaagtttattttaacgttaatttacccggttacgggttacgggtaccggtttaccgggacgttaaacgggggaacccttaaggggtacgtaacgttataccggtaacggtacggtaaaccggttgggtacggtacgtccggtaaccc

SEQ ID NO: 278906 - DNA, 589 bp, Homo sapiens
  misc_feature: GYAE6OF02ILH4X.19.71.G05.1.454.CMB.1.raw
  modified_base (238)..(238): a, c, t, g, unknown or other
  misc_feature (238)..(238): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcagtccagccactaatcttttanacagttaccaacaatagaaaacttacttagcttggtaccagcaagagaccaggacagccctaccgtaggctgcctctatttacctgggcacgtccgtacccgggaactcccggggtccctcgaccgtattcgagtggcaggcgggtctgggacagtatttcactctccacatcagcagcctgcagctagaagnttggngtctaagtttattacgttagtactaaacgtaatttaacttaatttaactacgtttacggtcgggttaaccgtttaccgggaccgtaaccggggaacctaagggtggtaattacgttacgaacgaccgtaacgttaggtacggtcgtacgtacg

SEQ ID NO: 278907 - DNA, 517 bp, Homo sapiens
  misc_feature: GYAE6OF02H8L2W.19.71.G05.1.454.CMB.1.raw
  modified_base (317)..(317): a, c, t, g, unknown or other
  misc_feature (317)..(317): n is a, c, g, or t
  modified_base (495)..(495): a, c, t, g, unknown or other
  misc_feature (495)..(495): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagactccctggctgtgtctctgggcgagcgggccaccatcaactgcaagtccagccacaatcttttatacagttaccaacaaatagaaaaactacttagcttggtaccagcagagaccaggacagcctctaggctgctcatttacngggcatctacccgggaatccggggtccctcgaccgattcagtggcaggcgggtctgggacagtatttcactctcaccatcagcagcctgcaggcctaggaagatgtgctagtttattattgtacaaactatatttattatattcgtgtacgttcgccgtaagggccaaggtggatacngtagacgtaacgtgtgctgacc

SEQ ID NO: 278908 - DNA, 549 bp, Homo sapiens
  misc_feature: GYAE6OF02I0QFD.19.71.G05.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatagaaaactacttagcttggtaccagcagagaccaggacagcctctaggctgctcatttacnggcatcgacccggaatccggggtacctgaccgattcagtgcagcggtcgtgggacagtactttcgactctcaccatcagcagcctgcaggctagaagtagtgtgtacgtagtttaattattacggtactaaacgtaatttaacttaatttaacttacgttcggttaggtaccgttcggaccgtaacgggtacctaaagggtgtaatagtacgaagtacggaatggtcggtctacgacc

SEQ ID NO: 278909 - DNA, 522 bp, Homo sapiens
  misc_feature: GYAE6OF02JQEGF.19.71.G05.1.454.CMB.1.raw
  modified_base (319)..(319): a, c, t, g, unknown or other
  misc_feature (319)..(319): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatacagttccaacaatgaaaactacttagcttggtaccagcagagaccaggacagcctcatagctgctcatttacngggcatctaccgggaatccggggtcctgaccgattcagtgcagcgggtctgggacagtatttcactctcaccatcagcacgctgcagctagacgagtcgtgactagtttatattgtacaactaattattattattacgttacgtgggtacgttcggaccgaagggtaccgtaacggttggtagttagtacgtagacgtaacgg

SEQ ID NO: 278910 - DNA, 525 bp, Homo sapiens
  misc_feature: GYAE6OF02F2FG1.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtcctgaccgattcagtggcagcgggtctggggacagtatttcactctcaccatcagcacgcctgcaggctgaagatgtgctagtttattattgtacaactaattattaattatactttgtaggtacgttcgaccgtaagggtaaccaaggtacggaatagtcgagtacgtaactggtggtctgtaccc

SEQ ID NO: 278911 - DNA, 523 bp, Homo sapiens
  misc_feature: GYAE6OF02FLK73.19.71.G05.1.454.CMB.1.raw
  modified_base (417)..(417): a, c, t, g, unknown or other
  misc_feature (417)..(417): n is a, c, g, or t
  modified_base (513)..(513): a, c, t, g, unknown or other
  misc_feature (513)..(513): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgcaagtccagccacaatcttttatacagttccaacaatgaaaactacttaagcttggtaccagcagagaccaggacagcctccgtaggctgctcatttactgggcatcgtacccggaatccggggtccctgaccgattcagtggcagcgggtctggggacagtactttcactctcaccatcagcagcctgcaggctgaacgntgtggactagtttattattgtacaactattattatattacttcgtggtactttcggccaagggtactaaggtcgaatactacgagacgaacttggngtcgtgaccg

SEQ ID NO: 278912 - DNA, 479 bp, Homo sapiens
  misc_feature: GYAE6OF02HCNWP.19.71.G05.1.454.CMB.1.raw
  modified_base (302)..(302): a, c, t, g, unknown or other
  misc_feature (302)..(302): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagnggtctagagtggctgggaagacatatttcatgtcaacacgtgaatacaaattatgcaccatctgttgagagtcgactgacaatcaacgtagacacatcgaagaaccagttctcctgcagctgacctctgtgactccgaggcacggtgtatattactgtggaagaggaccccatagac

SEQ ID NO: 278913 - DNA, 562 bp, Homo sapiens
  misc_feature: GYAE6OF02HCN0Y.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatcacccgggaatccggggtcctgaccgattcagtggcagcgggtctgggacagatttcactctcaccatcagcagcctgcaggctagaagatgtggctagtttatattgtacaaactaattacttatttaatactttacgtaggtaccgtttaccggaccgtaaacggggaacccgtaaagggttcggaattaacgtacgtaacggaaccggtaaaccgttggttacgggtaccttcggaacccg

SEQ ID NO: 278914 - DNA, 600 bp, Homo sapiens
  misc_feature: GYAE6OF02GPPYW.19.71.G05.1.454.CMB.1.raw
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
  modified_base (477)..(477): a, c, t, g, unknown or other
  misc_feature (477)..(477): n is a, c, g, or t
  modified_base (585)..(585): a, c, t, g, unknown or other
  misc_feature (585)..(585): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccacaattctttanacagttaccaactaatagaaaactacttagctttaggaccagcagacgaccaggacacgcctcgtaggctgctcatttacgngggctatccgtaacccgggagtcccggggtcctagaccgtattcgaggtcgcgaggtcgggtctgggacagtctttcactctacactactcgagccacgtccgtgaccgaggctaggagtagtggtagtacgttagttttattagttacgtanaaacgtattaactttatttaacgttacgtttcggtacgttacggttaccgaaccggtaaggggtacctaagggtacgtaagtacgtacgaacggtacgtaagttcggnggtacctagtaaccg

SEQ ID NO: 278915 - DNA, 528 bp, Homo sapiens
  misc_feature: GYAE6OF02GYVN1.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatcccggggtccctgaccgtattcagtcggcaggcgggtctggggacagtactttcactctccaccatcagcagcctgcaggctagaagatgngtctagtttatattgtacaactaattattaattattacttacgtgtaccgttcggaccgaagggtacctaaggtgatatacgagtacgtaacgtggtaggctgacc

SEQ ID NO: 278916 - DNA, 625 bp, Homo sapiens
  misc_feature: GYAE6OF02JN01R.19.71.G05.1.454.CMB.1.raw
  modified_base (228)..(228): a, c, t, g, unknown or other
  misc_feature (228)..(228): n is a, c, g, or t
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtcagccanaattctttagacagttccaacatgaaaactctagcttggtaccagcagagaccaggactagcctcctaggctgcttccatttacgnggacattaccgtaacccgggaattcccggggtaccctggaaccgtnttaccgaggtcggccgaggtccgggttnacggggaacctaaggtacttttcgaaccttcctacctaacctagttaccgaacgtcaacgccgttacgaccgaaggtcttaacggaaagtacgtcggtcgagttaacgttttaagttactttaggacctaaagtattaagtttaacttactaacgtttacgtaggttaccgttacgacgtaacgggaacgtaaggtgtaactagtacgagtacggtaatggtacggtcttacggacc

SEQ ID NO: 278917 - DNA, 569 bp, Homo sapiens
  misc_feature: GYAE6OF02ICZIO.19.71.G05.1.454.CMB.1.raw
  modified_base (324)..(324): a, c, t, g, unknown or other
  misc_feature (324)..(324): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccgacggggacatcgtgatgacccagtctccagactccctggctgtgtctctgggcgagcgggccaccatcaactgcaagtccagccacaattcttttataccagttccaaacatagaaactacttagcttggtaccagacagagaccaggacagcctcctaggctgctctatttacngggacatccgtacccggggaagtcccggggtccctgacccgtattcgagtggacaggcgggtcngggacagtatttcactctcacatcagcagccngcaggctagaagatggtggctagttttacttattgtacaaactaaagttatttaattaacttacgtttcggttacggtacggttaccgggccgtaaacggggtaaccaaggggttaggtaacttacgtacgagtaaccggtaattcggg

SEQ ID NO: 278918 - DNA, 528 bp, Homo sapiens
  misc_feature: GYAE6OF02I55CN.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgttgcttggcacgtgggtcaggcacgtccccatcgagaggtctagagtggctgggaagacatattcatgtaccaacacgtagaatacaaattatgacactatctagttgagagtcgactgacaatcaacgtagacacatacgaacgaacctagttcctcccgtgacacgctcgacctcgtcgtacgtaccgtccggaggtaccgtacgggtacgtaattacgttacgtaggtacggaacggaccggacccctagtacgtaac

SEQ ID NO: 278919 - DNA, 512 bp, Homo sapiens
  misc_feature: GYAE6OF02GBYQB.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtctagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtacaactaattattaattatacttcgtggtacgttcggaccaagggaccaaggtggaattatcagacgaactggtggctgacc

SEQ ID NO: 278920 - DNA, 561 bp, Homo sapiens
  misc_feature: GYAE6OF02HA76M.19.71.G05.1.454.CMB.1.raw
  modified_base (379)..(379): a, c, t, g, unknown or other
  misc_feature (379)..(379): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtgggtcaggcacgtccccatcgagaggtctagagtggctagggaaggactagtatttcattcgtaccaacgtacgtaggaaactaacaaatttancgacacctatctgtgagtagtcgactagaactaatacaacgtagacaacagtacgaaagaacctacgttacctccctagacacgtcctacgaccttcgtacgtcgaccgtcccggaacggtacgtacgggttagttaacgttagttacgtggtacggaacggaccggtaccccagtaaccgg

SEQ ID NO: 278921 - DNA, 561 bp, Homo sapiens
  misc_feature: GYAE6OF02GHXTF.19.71.G05.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (387)..(387): a, c, t, g, unknown or other
  misc_feature (387)..(387): n is a, c, g, or t
  modified_base (554)..(554): a, c, t, g, unknown or other
  misc_feature (554)..(554): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaatcttttanacagttccaacaatagaaaactacttagcttggtaccagcagagaccaggacagcctactaggctgctctatttacgnggctactccgtaacccgggaatcccggggtccctgaccgtattcgagtggcaggcgggtctgggacagtntttcactctcacatcagcagcctgcgtaggctagaacgtatggtgtacttagtttattattcgtaacaagtaattattaattaacttacgttaggtgtaccgttcggaacgaacgggtaacgtaaggtacggtaattacgtacgaagtacgtaagtcggtcggtacncgtaacc

SEQ ID NO: 278922 - DNA, 545 bp, Homo sapiens
  misc_feature: GYAE6OF02I9AF1.19.71.G05.1.454.CMB.1.raw
  modified_base (237)..(237): a, c, t, g, unknown or other
  misc_feature (237)..(237): n is a, c, g, or t
  modified_base (314)..(314): a, c, t, g, unknown or other
  misc_feature (314)..(314): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaccagcagagaccaggacacgcctctaggctgctcatttacgnggcactccgtacccgggaagtcccggggtccctggaccgtattcagtgcagcgggtcngggacagactttcactctccactancagcagctgcagctgaagntggcgctagtttatacttgtaccaaatattaactttattaacttacgttcggtaggtaccgtttcggacgtaacgggaaccgtaaggttggtaattacgtcaagtaccgaagttgtacggctaggtacc

SEQ ID NO: 278923 - DNA, 641 bp, Homo sapiens
  misc_feature: GYAE6OF02IPY4P.19.71.G05.1.454.CMB.1.raw
  modified_base (257)..(257): a, c, t, g, unknown or other
  misc_feature (257)..(257): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgcaagtccagccacaatcttttanacagttccaaacaatagaaaactacttagcttaggtaccagcagagaccaggacagccctcaggctgctctattacgnggcatccgtaacccgggtaactcccgggtccnggaccgtatttcaggtcggcgaggcggggtactggggaccaggtactttccacttcctacaccctagtccaggcctacgccccgttaggacccgtaagggtcctaggaaacgtgttcgggtacgtacttaagttttttatacgtttacggtaacctaaataacgtttatttaacgtttaactaccgttttacgggtacggttaacccggttaacggggtacccaaacgggggtaccctaaaggggttacggaaatttaccgtaacggtaacggg

SEQ ID NO: 278924 - DNA, 654 bp, Homo sapiens
  misc_feature: GYAE6OF02H1QN6.19.71.G05.1.454.CMB.1.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (322)..(322): a, c, t, g, unknown or other
  misc_feature (322)..(322): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacgatacgactgactaagtcagccacaattctttanacagttccaanaatagaaaactcttagcttaggaccagcagacgaccaggacagcctacgtaggctgctacactttacgngggactacgtaccgtaccgggaacgtccggggtccctaggacccgtattcgacggttggccgtagggtccgggtcgttacggggaacctaggtaacgttttcccacgtttaccgtacctaacccagttaccgaacgcgtaccggacccgttgaccgacggtccgttaaggaacgttacgtcggtaggacgtttaacgttttattaacgttcgtaactaaacttaaagttactttaagttacgtacgttcggtacgtaccgttcggaacgtaacgggacgtaaggtagtacgttacacggtaaggtaccgtaagtcggtaggtacctaggacc

SEQ ID NO: 278925 - DNA, 522 bp, Homo sapiens
  misc_feature: GYAE6OF02FW055.19.71.G05.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (518)..(518): a, c, t, g, unknown or other
  misc_feature (518)..(518): n is a, c, g, or t
tcagtactctcgtgcacgaccggtgctcgatttagtgtcgtcgcaagagagaggggggaggtacaacaggcagggcaggggcagcaagatggtgttgcagacccaggtcttcattttctctgttgctctgggatctctggtgcccacgggggacatcgtgatgacccagtctccagactccctggctgtgtctctgggcgagcgggccaccatcaactgcaagtccagccaanaatcttttaanactagttccaacaatagaaaactacttagcttaggtaccagcagagaccaggacagcctctaggctgctanatttacgngggcagtcgtaacccgggatcccggggtcctgaccgtatcagtggcaggcggtctgggacagtactttcactctcaccatcagcagcctgcaggctagaagntggngactagtttattnttacgtanaaactatattattatacttgtagacgttcgcgtaaggacgtaggtgactagtcagtacgagtgtacgntgac

SEQ ID NO: 278926 - DNA, 537 bp, Homo sapiens
  misc_feature: GYAE6OF02JFYAU.19.71.G05.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacgatacgactgacaagtccagccacaatctttanacagttccaanatagaaaactctagcttggtaccagcaganaccaggacagcctctaggctgctcatttacnggcatccgtaaccgggatccggggtccagaccgattcagtcgacnggcggtcngggacagtctttcactctacacatcacgcacgctcgcgcgacgtagagagtcgtcgtcgtagttagttattacgtactaactaactattagttactacttacgtacgtacgtcgtacgtacggaacgtaacgtaggtagtagtacgtacgtacgtacgtacgtacgtcgtgacg

SEQ ID NO: 278927 - DNA, 532 bp, Homo sapiens
  misc_feature: GYAE6OF02HC6VP.19.71.G05.1.454.CMB.1.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
  modified_base (368)..(368): a, c, t, g, unknown or other
  misc_feature (368)..(368): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccgagccacaattcttttaanacagttccaacaatgaaaactacttagcttaggtaccagcagagaccaggacagcctctaggctgctcatttacngggcagtctaccgggaatccggggtcctgaccgattcgagtgcaggcggtngggacagatttcactctcacatcagcagcctgcaggctagaagagtgtgctagtttattattgactaacaattattattattacgtcgttggtaccgttcgacgtaagggtacctaagggtggaattagtacgaaggtacgtaacgttggtggtactgtacccg

SEQ ID NO: 278928 - DNA, 592 bp, Homo sapiens
  misc_feature: GYAE6OF02ISKCZ.19.71.G05.1.454.CMB.1.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccanatctttanacngttccaacaatagaaaacttacttagcttggtaccagcagacgaccaggacaggcctccgaggctgctcatttacnggcatccgtacccgggaatccggggtccctagaccgattcgagtggcaggtcggtgnggacagtacttcactctaccactancagcncgcctgacgngatagaagngttgtgtacttagtttaattgtacgtaactaaagttaactttaattaatttacgttacgttacggttacggtaccggtttaccgggaccgtaaacgggtaccgttaaagggtgtaacgttactacggtaaacgtacggttaaccggttggtacggttacctcgtaacccg

SEQ ID NO: 278929 - DNA, 513 bp, Homo sapiens
  misc_feature: GYAE6OF02F382N.19.71.G05.1.454.CMB.1.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (411)..(411): a, c, t, g, unknown or other
  misc_feature (411)..(411): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctacccgggatccgggtcctgaccgattcagtggcagcggtctggacagatttcactctcaccatcagcagcctgcaggctagaagntgtggactagttttattattgtacaataattattattattacttcgtggtaaccgttcggaccgtaagggacctaagggtcgtaatatcgagtacgacttgg

SEQ ID NO: 278930 - DNA, 528 bp, Homo sapiens
  misc_feature: GYAE6OF02IICLR.19.71.G05.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttacnggcatccgtacccgggaatcccggggtccctcgaccgtattcagtggcaggcgggtctggggactagtatttcactctcaccatcagcacgcctgcagctagaagntgtgctagtttattattgtactaactaattattattatacgttcgttagacgttcggactaagggaacctaagggtgtaatatagtacgacggtaacttggcggtctgtacc

SEQ ID NO: 278931 - DNA, 748 bp, Homo sapiens
  misc_feature: GYAE6OF02G4147.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgcgtctctgggcgagcgggccaccatcaactgcaagtccagccacaatcttttanacagttccaacaatagaaaactacttagcttggtaccagcagagaccaggacagcctcctaggctgctctatttacgtgggctacgtaccgtacccgggaacgtcccgggggtacccctggacccgtagttccgaacggttcgggaccgtagggtccggggttacgtacggggacctacggtacgttttccgaccgttcctacccgaaccctacgttaccgacgtacccgaacggtcccgttaggacccgtaagggtccgtaacggtaaacggtacgttagggtacgggtaccgtttaaggtttttaactttaacgttttacgtaaccgttaaaacttaaacgtttaacgtttttaactttaactttaaccggttttcgggttaccgggttaccggtttaccgggaacccgttaaacgggggtaacccgtaaaggggttacggtaacgttaacgtttaacgtaacggtaaccggtaaccgttggggttacggtaccgtacgtaaccccgg

SEQ ID NO: 278932 - DNA, 647 bp, Homo sapiens
  misc_feature: GYAE6OF02GW7X6.19.71.G05.1.454.CMB.1.raw
  modified_base (248)..(248): a, c, t, g, unknown or other
  misc_feature (248)..(248): n is a, c, g, or t
  modified_base (442)..(442): a, c, t, g, unknown or other
  misc_feature (442)..(442): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtcgcgtgggcgaggccgggccaccatcaactgacaacgtccagcccaactaattcttttaanacctacgttaccaacaatacgtaaaacttacttagcttacggtaccagcaagacgaccgaggacacgcctccgtaggctcgctcgtactttacgcggactacgtcccgtacccggggtacgttcccggggtacctcggaccgtgttacgaggtcggcgacggtcggtcgtaggactagtacttcactctacacntacgacgcacgtcgagacgtagcgttagagtgtcggtagtactttagtttacgtacgttacgtactacgttactttacttttacgttttaccttaccgttaccgtaccggtcggttacccggtacggtaacggtaacgggacggttaacggtacgtaacgtacggaacggttacggtacggttacggacgttacgacgttacccg

SEQ ID NO: 278933 - DNA, 538 bp, Homo sapiens
  misc_feature: GYAE6OF02GDRWR.19.71.G05.1.454.CMB.1.raw
  modified_base (238)..(238): a, c, t, g, unknown or other
  misc_feature (238)..(238): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaacaatagaaaactacttagcttggtaccagcagagaccagacagcctcctaggctgctcatttactgggcagtccgtacccgggaatcccggggtccctgaccgtattcgagtggcaggcgggtctgggacaggtactttcactctcaccatcagcacgcctgcgagctagaagtatgnggctagtttatagtntacaatattagttattatactttcgagtacgttcggaccgtaagggaccgtaaggtaggtaatatacgaacgtacggtaactggtacggctagtacc

SEQ ID NO: 278934 - DNA, 622 bp, Homo sapiens
  misc_feature: GYAE6OF02G0R65.19.71.G05.1.454.CMB.1.raw
  modified_base (239)..(239): a, c, t, g, unknown or other
  misc_feature (239)..(239): n is a, c, g, or t
  modified_base (326)..(326): a, c, t, g, unknown or other
  misc_feature (326)..(326): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacattcttttanactacgttaccaactaatacgaaaactacttagcttaggtaccagccagagaccaggacagacctccgaggctgctactatttacgnggctagtccgtaaccgggaactcccggggtcctgaccgtattccgaggtcggactagggcggtcgtagggactacggtactttacgactctaccacctatcgacgcgactccgtgacgtacggctaggaagtgtggtacgtacttaagtttagttacgttacgtacaaagttaattaagtttaacttaacgttacgttacggtacggtaccgttcggaaccgtaacgggtaacggtaaggtcggtaacttaacgtacgtaacggtacgtaacggtcggtacggtcgtacgtacccg

SEQ ID NO: 278935 - DNA, 225 bp, Homo sapiens
  misc_feature: GYAE6OF02GWK47.19.71.G05.1.454.CMB.1.raw
  modified_base (219)..(225): a, c, t, g, unknown or other
  misc_feature (219)..(225): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggctggcaaggcgcatagnnnnnnn

SEQ ID NO: 278936 - DNA, 586 bp, Homo sapiens
  misc_feature: GYAE6OF02I6SS8.19.71.G05.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (422)..(422): a, c, t, g, unknown or other
  misc_feature (422)..(422): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacatcaactgcaagtccagccacaatcttttanacacgttaccaacaatagaaaactacttagcttaggtaccagcagacgaccaggacagcctcctaggctgctacatttacnggtacagtcctacccgggaatcccggggtcctagacgtattccaggtcgctaggcggtctgggactagtactttcactctacacctatcagtcacgcctgacgnggtactgaagtacgtgtagacttaggtttacttagttacgtactaacgtaattatttaagttaattaccggttagtacggtacgttcggtaccgaacgggtaacgtaagggtacgtaagttacgtacggaacgtacggtaacgttacggtggactacggtaccc

SEQ ID NO: 278937 - DNA, 611 bp, Homo sapiens
  misc_feature: GYAE6OF02FXQMG.19.71.G05.1.454.CMB.1.raw
  modified_base (238)..(238): a, c, t, g, unknown or other
  misc_feature (238)..(238): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanactagttccaacaatacgaaaactacttagcttaggtaccagcaagagaccaggacagcctcctaggctgctctattacgnggcatcctaccgggagtcccggggtcctgaccgtattcgagtcggcacggcgggtcgtggggacaggtactttcgacttctacaccatccgagtcacgtcctgaccgagggtctaggaacggtagtaggtcggacttaaggttttaacttagttacgtactaaactaaagtttatttaactttaattaccgtttcggttacgggtaccgtttcggaaccgtaacggggtaacctaagggtagtaacgttagtacgaaggtacggaaaccgttggtacgggtacctggtaccc

SEQ ID NO: 278938 - DNA, 559 bp, Homo sapiens
  misc_feature: GYAE6OF02IZTYE.19.71.G05.1.454.CMB.1.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (423)..(423): a, c, t, g, unknown or other
  misc_feature (423)..(423): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatacgaacgtgacaagtccagccacattctttanacagttccaanaatagaaaactacttagcttggtaccagcagagaccaggacagcctcgtagctgctcattacgtggcatcgtacccgggaactccgggtacctgacgnttcgagtgcaggcgggtntaggacagtattcactctccacatcagcacgctgcaggctagtaagngtagtgtacttatttagttagttgtaactaactaaagttaattatttacttacgtttacggacggtttacggttacggaacgtaacgggtaacccgtagggttacgtaacgtacgtacgaacgtacgtacgttagg

SEQ ID NO: 278939 - DNA, 572 bp, Homo sapiens
  misc_feature: GYAE6OF02HZQMT.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctagagtggcgtaggggaagactatattcatcgtaccaaacgacgtaggaaataacgtaaattagtacgacctaacctattcgtagttagagtagtacgactgaactaatacaaacgtagaacacaatacgaaacgtaaccacgttacctcccgtagaccgacgtcctacgtacctcgtagtaccgtaccgtacccggacggtaaccgtacgggttataacgttatacgtggtacggaacggtaccggaccctagtacgaacg

SEQ ID NO: 278940 - DNA, 739 bp, Homo sapiens
  misc_feature: GYAE6OF02G1AWX.19.71.G05.1.454.CMB.1.raw
  modified_base (243)..(243): a, c, t, g, unknown or other
  misc_feature (243)..(243): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccactaattcttttanacacgttaccaaacaatagaaaaccttacttagtcttaggtaccagacagacgaccgaggacacgcctaccgagctgcctctatttacgtgggacctacgtaccgtaacccggggtacgtcccggggttacccaggacccgtattcgaggtcggacgtacgggtccggggtctaggggacctaggttactttccgaccttccgtacctaacctatccgaacgtccacggtccgtgaccgtaggtacctaagggtaagtacggttggtacgggtaacctttaaggtttttaacgttaagttttaccgtaaaccgttaaaaccgttaaagttttaacgttttaaactttaaacgtttacccggttttaacggggttaacgggtttaaccccgggtttaccggggtaacccggtaaacgggggtaaccgtaacgggttagtaacgttaacgtacggtaacgtaaccggttaacgttcgggtacggtactacgtaacccg

SEQ ID NO: 278941 - DNA, 563 bp, Homo sapiens
  misc_feature: GYAE6OF02G4CSD.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggagggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagacccagggacagcctcctaggctgctcatttactgggcatcctaacccgggatccggggtccctgaccgattcagtggctaggcgggtctgggacagatttcacctctcaccatcagccagcctgcaggtctagaagtagtgtggcctaggtttattattgtacaaactaattattattaacttacttcgtaggtaccgtttcggccgtaaaggggtaccctaaagggttacggaattacgtaccgaagaaccggtaagtcggtgggtctacggaccc

SEQ ID NO: 278942 - DNA, 505 bp, Homo sapiens
  misc_feature: GYAE6OF02GF0WE.19.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttacngggcatctacccgggaatccggggtccctgaccgatcagtgcagcgggtctgggacagatttcactctcaccatcagcacgcctgccgaggctagaagagtgtggctagtttattattgtcaataattattaattatacttcgtgtacgttgcaagggccaaggtgatanacgagacgaacgtgngctgaccc

SEQ ID NO: 278943 - DNA, 559 bp, Homo sapiens
  misc_feature: GYAE6OF02HUN9I.19.71.G05.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (412)..(412): a, c, t, g, unknown or other
  misc_feature (412)..(412): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaatcttttanacagttccaacaatgaaaactacttagcttggtaccagcagagaccaggacagcctcctaggctgctcatttacnggcatctacccgggaatccggggtcctgaccgattcagtgcaggcgggtctgggacagattttcgactctccaccatccagcagctgcaggctagagntgtagctagtttatgttagtacaactaattaatttattaatacgtttcgtagggtacgtttccgggacctaaacggggacccttaaaggggtcgtaagttacgtacgaacggtaacggtaaaccgttggtacgggtctacggaaccg

SEQ ID NO: 278944 - DNA, 573 bp, Homo sapiens
  misc_feature: GYAE6OF02I4NMS.19.71.G05.1.454.CMB.1.raw
  modified_base (237)..(237): a, c, t, g, unknown or other
  misc_feature (237)..(237): n is a, c, g, or t
  modified_base (449)..(449): a, c, t, g, unknown or other
  misc_feature (449)..(449): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttaggtaccagcagagaccaggacacgcctcctaggctgctctatttacgtgggctactcgtacccgggtaatcccgggggtaccctggaacccgtattccgaaggtcggcaaggtcggggtctaggggaactaggtacttttccactctaccaccatcagcagcctgcaggtctagaacgtntgtgactagtttattattagtactaacgtaattattattatacttgtagtaccgttcggaacgtacgggactaagggtagtacttagtacgaggacgtaaccgtggtacggtaccgtagtaccc

SEQ ID NO: 278945 - DNA, 554 bp, Homo sapiens
  misc_feature: GYAE6OF02FLYDN.19.71.G05.1.454.CMB.1.raw
  modified_base (244)..(244): a, c, t, g, unknown or other
  misc_feature (244)..(244): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacacgttaccaaacaatacgtaaaactacttaagcttaggtaccagcagacgaccaggacacgcctcctaggctgctctagtttactgggctatccgtaacccgggaatcccgggggtccctagacccgtattcgagtggcaggcggtctgggacagtacttcactctcaccatcagcagcctgcagcagangtcgtggactagtttattagttagtactaaactattatttattattacttgtacggtacggttcggaccgtaacgggtaccgaagggtcgtaatacgtacgaacggtacgtacgtagg

SEQ ID NO: 278946 - DNA, 781 bp, Homo sapiens
  misc_feature: GYAE6OF02FH11S.19.71.G05.1.454.CMB.1.raw
  modified_base (334)..(334): a, c, t, g, unknown or other
  misc_feature (334)..(334): n is a, c, g, or t
tcagtactctcgtgcacgaccggtgctcgatttagtgtcgtcgcaagagagaggggggaggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccaccatcaactgcaacgtccagccactaactcttttatacacgttaccaaacaatagaaactacttagcttacggtaccagtcaagacgaccaggacacgcctcgtaaggtctgccttactaactttaccgngggtaccacgttacccgtaacccgggtaacggttccccgggggtaccctacggtaacccggtacgtttaccgaacggttcgggaccgtaacgggtccggggttaccgtacgggggtaacctaacggttacttttacccaaccgttccttacccgaacccttaacgtacccgtaacggaccgtaaccggtcccgttacggaccgtaacggggtccctttaagggaaacggttacgttacgggttacgggttacctttaaacgggttttttaaacttaacgtttaccgttaaaccgaaaacgttaaattttaaacgtttttaacgttaaactttacccggttcgggtaacgggtaccgttaccggaaccgtaacggggtaaacctaaggggtacgtaagttaccgtaacgtaacggtaaccgaacggttgtaccggcgttacgtaaccc

SEQ ID NO: 278947 - DNA, 553 bp, Homo sapiens
  misc_feature: GYAE6OF02IE70X.19.71.G05.1.454.CMB.1.raw
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccaacaattcttttanactagttaccaacaatagaaaactacttagcttggtaccagcagacgaccaggacagcctcctaggctgctctatttacgnggcatccgtaacccgggaagtcccggggtacctgaccgtattcgagtggcaggcgggtnagggacagtactttcactctcaccatcagcagcctgacgagctagaagagtggtcgactagtttattagttagtacaaactaattaattattaatacgttacgtgtacgttcgaaccgtaagggaactaaggtagtaatactacgacgaacgtaatggtacgtcgtgaccg

SEQ ID NO: 278948 - DNA, 609 bp, Homo sapiens
  misc_feature: GYAE6OF02IF8CD.19.71.G05.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgactagccagccaanaacttctttaanactacgttaccaaactataagtaaaacttactagtcttcggtaccaagcaagagacccgaggacacgccctaccgtaggctacgctctattttacgnggactacgtacccggtaaccgggacgtcccgggtcccaggacctagttcaggttcggcaggtcgggtacgtagggactagtactttcgactctcactatcagctacgccgtgccgagtaccgaagaagtcgtggtacgtagttagttttaattagttaccgtaacaaattagtttaatttattaccgttacgttcggtacggtttaccgaccggtaacgaaccggtaacgtaggtgtaaactcgtaagcgtaaccgagttggactcgtatacc

SEQ ID NO: 278949 - DNA, 614 bp, Homo sapiens
  misc_feature: GYAE6OF02IQYWO.19.71.G05.1.454.CMB.1.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
tcagtactctcgtgcacgaccggtgctcgatttagtgtcgtcgcaagagagaggggggaggtacaacaggcaggcagggggcagcaagatggtgttgcagacccaggtcttcatttctctgttgctctggatctctggtgcccaggggacatcgtgatgacccagtctccagactccctggctgtgtctcgtgggacgcgccgggccacctatcaacgtnacagtccagcccacaagttctttaanactacgtaccaactagtagaaactactacgtacgtacgtacagtacgacgacgacgacgacgtacgtccgtacgtacgtcgtacgtactactacgttacgtacggtacgtacgtacgtaccggtacgtaccggtaccgtacgtacgtacgtcgtacgtgtacgtacggtcggtcgtgtacgtacgtacgttactctctactacgtacgtacgagtacgtcgtacgtacgtacgtacgtacgtacgtagagtacgtacgtcgtacttatactactatactactacttacttactactacgtagtacgtacgtacgtacggtacgtaagtaggtacgtagtagacgacgtacgtacggtcgtgtcgtacg

SEQ ID NO: 278950 - DNA, 609 bp, Homo sapiens
  misc_feature: GYAE6OF02HMA2C.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatctttanacagttccaacaatagaaaactacttagcttggtaccagcagacgaccaggacagcctcctaggctgctcatttacnggcatccgtaccgggaatcccggggtcctgaccgtatcagtgacaggtcggtcgtgggacagtactttcactcctcaccatcagcagcctgacgaggctagaagagttggacgtacttagttttatagttacgtactaaataagttaatttaatttacttacgtttacggttacgggtaaccgtttaccgggaaccggtaaagggtaacccggtaagggttaggtaaacttaacgttaaccgaacgggtaacccggtaaacgtttcggggtaacggtaccgttacgtaaccccg

SEQ ID NO: 278951 - DNA, 604 bp, Homo sapiens
  misc_feature: GYAE6OF02GRKNO.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgacaagtccagccacaatcttttanacagttccaaacaatagaaaactacttagcttaggtaccagcagagaccaggacagcctcctaggctgctcatttacgnggcatccgtacccgggatcccggggtcctgaccgtattcgagtgcaggcggtctgggacagtactttcactctacacatcagcacgcctgaccgaggctagaagtagtggtaggtcttaagtttattagttacgtaactaaacgtaaattatttaatttaacttacgtttacggtacggttaccggttccggaaccgtaaacggggtaacccgtaagggttacggtaacttaacgtaacgaacggtaaccggttaacgttacgggtacgggtacctaggtaacccg

SEQ ID NO: 278952 - DNA, 610 bp, Homo sapiens
  misc_feature: GYAE6OF02GIQ12.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttactggcatccgtacccgggaatcccggggtccctgaccgattcagtggcaggcgggtctgggacagactttcactctcaccatcacgcacgcctcgcaggcgtagaagagtgtgcgtagtttattattagttactaaactaattaatttaacccctttaattaccgtttacgttacggttaccggttaccgggtaccggtaaacggggtaacccggtaaacgggttacgggtaacgttaacgttaacgtaacggtaaccggtaaaccgttacgggttacgggtaccgtacggtaacccg

SEQ ID NO: 278953 - DNA, 578 bp, Homo sapiens
  misc_feature: GYAE6OF02H1I2I.19.71.G05.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (437)..(437): a, c, t, g, unknown or other
  misc_feature (437)..(437): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtcgtctctgggcgagccgggccaccgatcaactgacaagtccagccacaatctttanacagttccaactaatcgaaaactctagctggtaccagcagagaccagacagcctcgagctgctcatttacgnggctagtccgtacccgggaatcccggggtacctgaccgtattcagtcgacacggcggtctgggactaggtactttcgacttcctacaaccacgttacagcctagtcctgcgtaggactgaacgtntcggtagcttaagtttatacgtagtactaaatagttaattattaactacgttcgacgttaccgtcggaaccgtaaacgggtcctaagggttctaacgttaacgtctaacggtacgtaaccgttggaccggtctcgtaaccc

SEQ ID NO: 278954 - DNA, 553 bp, Homo sapiens
  misc_feature: GYAE6OF02JQ9P0.19.71.G05.1.454.CMB.1.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcagggcagcaagatggtgttgcagacccaggtcttcatttctctgttgctctggatctctgttgcccacggggacatcgtgatgacccagtctccagactccctggctgtgtctcgtgggcgagcgggccacatcaactgacacnggtcccaagccactaatccttttanaccagttaccaacaaatgaaaactacttaggctggtaccagcaagagaccaggacagcctcctaggctgcttcagtttacnggcacgtctacccggggaactccggggtaccctggtacccgattcgagtggcgtagcgggtctgggactagatttcactctcaccatcagcagcctgcaggctagaagtagtgtaggtctagttattatagtactaactattaattattactacgttcgttggtacgttcggaccgtaagggtaccaagggtagagtaatacgaacggtacgtaacgtgtaggctacg

SEQ ID NO: 278955 - DNA, 534 bp, Homo sapiens
  misc_feature: GYAE6OF02G2AYG.19.71.G05.1.454.CMB.1.raw
  modified_base (267)..(267): a, c, t, g, unknown or other
  misc_feature (267)..(267): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcctccggggacagagtcgctagcgacagtnttgcttggcacgtgggtcaggcagtccccatcgagaggtctagagtggctgggaagacatattcatgtaccaacgtacgtagaatacaaattatgcactatctgttgagagtcgactgaacatacaacgtacgacacagtacgaacgaactacgttacctaccgtagacgagtctacgacctcgtacgtacgaccgtccggacggtacgtacggtagtaacttacgttacgtaggttacggacgtaccggacccctagtacgtaccg

SEQ ID NO: 278956 - DNA, 521 bp, Homo sapiens
  misc_feature: GYAE6OF02F68OH.19.71.G05.1.454.CMB.1.raw
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttacnggcatctacccggaatccggggtccctgaccgattcagtggcagcgggtctgggacagtatttcactctacaccatcagcagcctgcaggctagaacgtgtgtggtctagtttattattgtactaaactaattaattattatacgttcgtggtacgttcggaccaagggtacccaaggtaggatatcgagacgaagtgtggctgacc

SEQ ID NO: 278957 - DNA, 544 bp, Homo sapiens
  misc_feature: GYAE6OF02HKX69.19.71.G05.1.454.CMB.1.raw
  modified_base (238)..(238): a, c, t, g, unknown or other
  misc_feature (238)..(238): n is a, c, g, or t
  modified_base (322)..(322): a, c, t, g, unknown or other
  misc_feature (322)..(322): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcaagacgacccaggacacgcctacctaggctgcctcatttacgngggcactccgtacccgggaagtcccggggtccctggaccgattcaggtggcaggcgggtctgggacagtactttcactctcaccatcngcagcctgcaggctgaangtggngctagtttattnttagtacaaactaattatttattattacgttcgtagtcgttaccgacgaacgggtaacctagggtgaacttgtacgagtacgtacgtggtcggctgacc

SEQ ID NO: 278958 - DNA, 776 bp, Homo sapiens
  misc_feature: GYAE6OF02J3W86.19.71.G05.1.454.CMB.1.raw
  modified_base (542)..(542): a, c, t, g, unknown or other
  misc_feature (542)..(542): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctcgtggatctcgtcggtcgcccgacgggtactacgtcggtagaacgtccgacccgtacgtcctaccgtacgtacccgtcccgtggtctcggttcgtccgtacggtcgggacgacggccggaccacctataccgaactcgacgtaccgtccacgacctaattaactttacttaacgacgtaccgtaacaaacgtactaacgtaacttcgtactaccgttacgacgtacgaacgacgacgtaccgtacggacctaccgtcctacggtacgtcgtactaccttacgttacgtaccggtacgacctaccggttacccggtacccggtcggttacccgtccaagtccggttctacggcggtcgacggtacgtcgggtaacgtaccggtataccgtacttccgacgtaccacgacttggaaccnccggtacgtacccgtacgtacggaacgtacggtaacgtaggtacgttaggtacgttacgttaacgtttatttaaccgtattaaccgtacgtttaaaatagttttaaccgttacgttccgttaacggtccggtacggtaaccggtaccgaaggtaaccggttaacgtaggtaaccttaaccggtgtaaaccggtcgttaaccggtacgtggaacccgtttagaccccgttaaccg

SEQ ID NO: 278959 - DNA, 565 bp, Homo sapiens
  misc_feature: GYAE6OF02GW4RL.19.71.G05.1.454.CMB.1.raw
  modified_base (368)..(368): a, c, t, g, unknown or other
  misc_feature (368)..(368): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttactctggatctctggtgcccacggggacatcgtgatgacccagtctccagactccctggctgtgtctctgggccagcgggccaccatcaactgcaagtccagccacaattcttttatacagttaccaacaatagaaaactacttagcttggtaccagcagagaccaggacagcctcctaggctgctcattactggcatccgtacccgggatccgggtccctgaccgattcagtggcaggcgggtcngggacagtactttcacttcctacacctatcagccagcctgcgacggctagaagtatggtgactaggttttattattcgtacaacgtaattaatttattattacgttcgtagtaccgttacgaaccgtaagggtaaccgtaaggtacggtaatacgtacgaaggtaccgtaacgtggttacggcgtacgacctaaccg

SEQ ID NO: 278960 - DNA, 557 bp, Homo sapiens
  misc_feature: GYAE6OF02G968Z.19.71.G05.1.454.CMB.1.raw
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (390)..(390): a, c, t, g, unknown or other
  misc_feature (390)..(390): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccactaattcttttatacacgtttccaaactaatagaaaaacttacttaagcttcggtaccagccagacgaccaggacagcctactaggctagctnatttacngggctatccgtaccgggatccgggtcctagaccgatcgagtgacaggcggtcngggacagactttcgacttctacaccatcgagcacgctagcaggctacgagtacgtgtcggtacttagtttagttattacgactaactaaatattatttatacgttcggtaggtacgtttacgacgaacgggtaccaaggtacgtatacgacgaagtacgtagtacgg

SEQ ID NO: 278961 - DNA, 915 bp, Homo sapiens
  misc_feature: GYAE6OF02HLULJ.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacgggacatcgtgatgacccagtctccagactccctggctgtgtctcgtgggcgagcgggccaccatcaactgcaagtccagccacaattcttttaanactacgttccaaacaatagtaaaacttacttagacttaggtaaccagacagacgaccgaggacacgccctaccgtaggctcgccttactactttacgtcgggctaacgtccggtaacccgggtaacgttcccgggggtacccctacggtaacccgtactttaccgacggtttcgggaccgtagggtccggggtacgttacgggggaactaacggtaccttttaccgaccgttaccgttacccaacccgtaacgttaccgaaccgggtacctaaccgggttcccgtaggaccgggaaacgggttaccgttaaggggtaaaaccggttacgtttcggggttaacgggttaccgttttaaagggtttttttaacgtttaaacggtttaccggttaaaaccttaaaacgtttaaaacgtttttaaaccgtttttttaaagtttaaacccgttttaaaccggttttaccgggggtttaaccggggttttaaaccccggggttttccccgggggtaaaacccgggtttaaaaccgggggggttaaaccccgtttaaaagggggggtttaaccggttaaaacgtttaaacccgggtttaaccggtaaaccgggggtttaaaacccggttaacgggtttaaccggggttttaccggggtaaccgttacccggggttaaaccccc

SEQ ID NO: 278962 - DNA, 594 bp, Homo sapiens
  misc_feature: GYAE6OF02GKA22.19.71.G05.1.454.CMB.1.raw
  modified_base (244)..(244): a, c, t, g, unknown or other
  misc_feature (244)..(244): n is a, c, g, or t
  modified_base (323)..(323): a, c, t, g, unknown or other
  misc_feature (323)..(323): n is a, c, g, or t
  modified_base (455)..(455): a, c, t, g, unknown or other
  misc_feature (455)..(455): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcaagacgaccagacagcctccaggctagctcatttacgngggcacgtccgtaacccgggaagtcccggggtccctacggaaccgtattccgaggtcggacagggtccgggtcgtaggggaacaggtacttttccgacttctcaaccactcagccagcctgcaggctagaangttgcggactttaggttttattagttgtaacctaaactaaatttaacttaattacgttacgttcggttacgggtccgtttacgggacccaaagggtaccctaagggtacgatttaactacgaacggtacgtacttaggg

SEQ ID NO: 278963 - DNA, 753 bp, Homo sapiens
  misc_feature: GYAE6OF02IKGIJ.19.71.G05.1.454.CMB.1.raw
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (673)..(673): a, c, t, g, unknown or other
  misc_feature (673)..(673): n is a, c, g, or t
tcagtactctcgtgcacgaccggtgctcgatttagtgtcgtcgcaagagagaggggagagtctgctgaattctggctgaccagggcagtcaccagagctcagacaatgtctgtctaccttctcttcttcctgccgtgctagggcctccganaaggtntcctgtcacagacagctgcagcagtcaggtccaggctggtanacgtcctgacacgacccttntccgctcaccttgctaccagtccgtccggganacgtacgtcgctacgcgataggttgttgacgtttggactacggttgggtaccaagggtcctacggttacccctagtccggtaacggtacggttccgtaaggtacggtcggtacgtaacggggaacgtacgtacgtttaacttacgacgttacgtaccgtaacgtaggtacgtaaactaacgttaattacgcgtaacctacgtattccggtagttaccgaaggtcgttacgacgttacgtaaccgtaacgttacgtaaaccggttacaacgttaccgtaaggttaacccggtaaacggttaaccgttaccggttttaccgaccggttcgtaaaccgtcgttacccgttaacgttaacccgtttcggtttaaccggtacgttacccggttacccgggtaacggtaaccgggttaaaccggtttntaaaccgtttaaccgggtttacgttacggggtaaccgtaaccggttacccggtacccgtttagtaaacccggttaacccg

SEQ ID NO: 278964 - DNA, 846 bp, Homo sapiens
  misc_feature: GYAE6OF02IS06Y.19.71.G05.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (305)..(305): a, c, t, g, unknown or other
  misc_feature (305)..(305): n is a, c, g, or t
tcagtactctcgtgcacgaccggtgctcgatttagtgtcgtcgcaagagagagggggagggtacgaacaggcaggcaggggcgagcaagatggtgttgcagacccaggtcttcatttctctgttgctctggatctctggtgcccacgggacatcgtgatgacccagtctccagactccctggctgtgtctcgtgggcgagcgggtccaccatcaaccgtgacaacgtccagccanaacttcttttanacagttccaaacaatagaaaacctattagtcttacggtaaccagccgaagagaacccnggaacaagccttaccgtaggctcgtctactacgtttaactgggcaacgttccgtaaccccggggtaagttcccgggggttccccaggtaaacccgtgtttacccaagggttacggcaacgggttcgggggtaccttagggggaactaaccggtttacttttacccggtaacgttcccgaacctaccgtaacccgttacgtacggaaccgttacgccccgttaaggccgtaaaccgggcgttaaccggaaaggtaaccggtttagggttccgtaaacggttaaggtttttaacctttaaaggtttgttaacccccaaaaacggttaaattttaaaccggttttaaactttttaaaccgggttcccggtttttaaaccgggttaacggggtttccccggggtttacgttaaccccgggggaaaaaccggggtttaaccggaaaaccggggttttaggggtaaaccttaacccgtttaacggttaacccggaaaacccgggtttataaccgggggtttttcgggtacccgaccgggttaacccg

SEQ ID NO: 278965 - DNA, 596 bp, Homo sapiens
  misc_feature: GYAE6OF02II1S6.19.71.G05.1.454.CMB.1.raw
  modified_base (550)..(550): a, c, t, g, unknown or other
  misc_feature (550)..(550): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctccgctcaccctgtcgccatccgtccggggacagagtcgctagcgacagtgttgcgttggctacgtgggtcaggccacgtccccagtcgagagtctagacgtggcgtgggaaggctattacttcatcgtaccaacgtacggtaaggaaactacgtaaaatttagtcgacctaaccgtattccgttgtttacggaagtagttccgaacttacggaactaacgtacaaacggtacgaactaaccacgtacgaaacgtaactacgtttaccctcccgtagaccgacgtctacgtacctctacgtcgaccgtccggaggaccgtacgggtntaattacgttacgtggtacggacgtaccggaccccgtagtagaccg

SEQ ID NO: 278966 - DNA, 577 bp, Homo sapiens
  misc_feature: GYAE6OF02GUDBW.19.71.G05.1.454.CMB.1.raw
  modified_base (239)..(239): a, c, t, g, unknown or other
  misc_feature (239)..(239): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
tcagtactctcgtgcacgaccggtgctcgatttagtgtcgtcgcaagagagaggggggaggtacaacaggcaggcaggggcagcaagatggtgttgtagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaaacaatagaaaactacttagcttaggtaccagcagacgaccaggacagcctccgtaggctgctctatttacgtggcatccgtacccgggaatcccgggtcctgaccgtattcgagtcgcaggcggtcngggacagtactttcactcncaccatcagcagcctgcgaggctagaagtgtggtgacttagttttacttagttacgtactaaactaatttaattaattacttacgttcggttaggtaccgtttacggacgtaacgggtaccgtaagggtaggtaactacgtacgtaaggacgtaacgttggtacggcgttacgacctaaccg

SEQ ID NO: 278967 - DNA, 871 bp, Homo sapiens
  misc_feature: GYAE6OF02JAFCI.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggactcctgtcggccgaccggacgggactgtcgtagtacgtaccgaccgtcgtccaccgacgtccctccggtgtcttgttcgtcgtcgggcgggacggcggccggaccacgtactaaccgacgtcgaactaccgtccgacgacctaatttacttttactttaacaccgttaacctaacctaaactaaggtaaaaccttaaaaccttacgtacgttacggttaccgaaccagaaccgaacggaaccgaccggtaaagaccgaccgttcccgtaccggagtccgttacgaccttaacgtttacggttaaccgggcggaccttaaaccggtacccgggttaaaccccgggccgggtttccccggtacaacgtacgttaacgtcggtacggtccggaacggtcggggttccgggtcgtaaggtaacgttactttaaccgtttccaacccgtttcccaaccgtaacctacgacccgtaacgtacccgggtacccgttaccggacgggtacccggttacggaaccgttaaagggtaccggtaacgggtttcgggttacgtttaaaccttttttagggttttaaatttccgggtttaaaccaaacgtttaaaacttttaagttttaaactttaacgttttacccgttcgggtttacggtaccgggtaacccggttaccggaaaacgggtaacgggttacggtaaggttcggtaacttaccggaagtaaccgggtagtacgttggg

SEQ ID NO: 278968 - DNA, 579 bp, Homo sapiens
  misc_feature: GYAE6OF02GA2RW.19.71.G05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (433)..(433): a, c, t, g, unknown or other
  misc_feature (433)..(433): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatacaactgcaagtccagccacaattcttttanacagttccaacaatagaaaactacttagcttggtaccagcagagaccaggacagcctccgtaggctgctctatttacgngggcatccgtacccgggaatcccggggtccctaggacccgtattcgagtcggcaggccgggtctggggacaggtactttcacgtctacaccatcagcacgcctgcagctgaagntgtggctaagtttatagttacgtactaaacgtaattatttaattattaccgtttaggtacggtaccgtttacgggaccgtaaagggccgtaaaggtggtaacttaagtcgaagtacggtaaccgttgggtacggtccgtagtaccg

SEQ ID NO: 278969 - DNA, 568 bp, Homo sapiens
  misc_feature: GYAE6OF02GZ5UX.19.71.G05.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttaanacagttaccaacaatagaaaactcttaagcttggtaccagcagagaccaggacagcctcctaggctgctcatttacnggcatccgtaccggatccgggtccngaccgnttcgagtgcngcgggtntaggacagtactttcactcncactatcagcacgctgcagcgtagaagtntgcggtactagtttacttgttacgtacaaacttaagttaactttaatttaagttacgttcggtacggttaaccgtttcgggaccgtaaacgggtaccgtaaggtacggacgttagtacgaacggtaaccgtagttaggtcggtacttaggtaccc

SEQ ID NO: 278970 - DNA, 706 bp, Homo sapiens
  misc_feature: GYAE6OF02IK610.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtggcgagcgggccaccatcaactgacaagtccagccacatcttttanacagttccaacaatagaaactactagcttggtaccagcagagaccaggacagcctcgtaggctgctactatttacgtgggacactccgtacccgggtaacgtcccggggtccctacggaccgtacgttacaggtcggacgaggtccggggtacgtcggggactagtacttttaccaccttactaccacctactacgagcacgtccctgaccgtaggtcctaaggaacgacgttagggtcggactttaaggttttaagttttaacgttacggttaacctaaaacgttaaatttaatttaacgttttaaacgtttacgtttaccgggttacgggtaacccggttttaccggggaaccccggtaaaacgggggtacccgttaaaggggttacggtaaacgtttaacgtaaccggtaaccggttaacccggtaaacggttacgggtacgggttacccgtacgggtaaccccg

SEQ ID NO: 278971 - DNA, 594 bp, Homo sapiens
  misc_feature: GYAE6OF02GB3SU.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaattcttttanacacgttaccaacaatagaaaacttacttagctttaggtaccagcagacgaccaggacacgcctactaggctgctctatttacgtggctatccgtaacccgggaagtcccggggtaccctagacccgtattcgagtggacgaggcgggtcgtgggacaggtactttcacgtctacacctatccagccagccctgaccgaggcctaggaagtacgtaggtcggacttagtttaattatagtacaaacttaagttattaacttatacgtttcggtaggtaccgttcggacctaaggttcgaaccgtaagggtgtaacttagtacgtaacggaaccgtaagttcggtaggtctacgg

SEQ ID NO: 278972 - DNA, 543 bp, Homo sapiens
  misc_feature: GYAE6OF02HHWW1.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccagacagcctcctaggctgctcattactggcatcgtacccgggatccggggtcctgaccgtattcgagtggcaggcgggtctgggacagatttcactctcacatcagcagctgcaggctgaagatgtgctagtttattattacgtactaaactattaacttattaattacgttcgtaggtacgttcggaccgaaagggtaccaagggttagaattacgtacgaacggtaaccgtaacgttggtacggtcctaggtaacc

SEQ ID NO: 278973 - DNA, 799 bp, Homo sapiens
  misc_feature: GYAE6OF02I6GZW.19.71.G05.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcaagtccagccanaacttctttanacagttaccaanaatagaaaactacttagcttggaccagacaagacgaccgagacacgcctccgtaggctgcctactatttacgnggcagttaccgtacccgggaagttcccggggtccctacgaaccgtatttccgaaggttcggaccacgggtcggggttaccgttaggggacctaaggttaccttttaccgaccgtaccttaccgaccctaagttacccgaagtcccgaacgtacccgttcggaccacggggtaccttaacgggtaaaggtacgttcggggttacggttacgtttaaacggtttttaacgttttaacggttacccgttaaacttaaaaccgtaaaagttttaacgtttttaaactttaaaccgttttaaccggtttttaccgggttaacggggttaacccggtttttaccccggggaacccgggttaaaaccgggggtaaaaccccgggtttaagggttaacggggtaacgttaaaccggtttaacgaaccgggttaaaccggtaaaccggtttgggtttacccgggttaccggtacggttaaacccg

SEQ ID NO: 278974 - DNA, 704 bp, Homo sapiens
  misc_feature: GYAE6OF02IJEXB.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgacagtgttgcttggcacgtgggtcaggcacgtcccatcgagagtctagcgtggcgtagggaaggactagttactttcaattcgtaccaaacgtacggttacggaaaacttaactaaaaagtttacgtacgtacctaacctaacgttcgttaggtttacggtaaggtaacggttacggtaaccgttaacggtaaactaaacgttaaccgtaaacggtaacgaaccgtaactaacgtaaccggaaaaccgtaaacccgtaacgtttacccgttaccccgtacggtaccgtaacgtaccgtaccgtaacccgttccgttacggtaccgtacccggttacccgggaacgggtaacccggtacggggttaacgttaacgtttaacgtttacgttacgggtaacgggtaaccgggtaacccggtacccccgtaagtaacccgg

SEQ ID NO: 278975 - DNA, 721 bp, Homo sapiens
  misc_feature: GYAE6OF02GT8U2.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaagccctgcacgacccctctcgctcacctgtcgccatccgtccggggacagagtcgctagcgacagtgttgcttggcacgtgggtcaggcacgtccccagtccgaggacggtctaggaggtggcgtaggggaacggactattattcattcgtaccaacgaccggtaggtaaactaactaaaagttacgtacgtaccaacctattccgtttaggttaggaaggtacggttaccgtaacgttacggaaaccctaaacgttaaccgtaaaacggttaaccggaaactaaaccgtaacgttaaaccggaaaaccggtaaacccgttaaccggttttaccccgttacccgtacggtaacccgtaacggttaccgttaccggtaccccttacgttacggttaccgtacccgttacccggtaacgggtaaccggttaccggggtttaagttaacgtttaacgtttaacggttacggtaacggggaaaccggtacccggtacccccgtaaggtaacgtaaaccgg

SEQ ID NO: 278976 - DNA, 618 bp, Homo sapiens
  misc_feature: GYAE6OF02F08IT.19.71.G05.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttaagcttaggtaccagcagagaccaggacagcctccgtaggctgctcatttacgnggcatccgtacccgggaagtcccggggtccctgaccgattcagtcggcaggcgggtctggggactaggtactttcactctcaccatcagcaagcctggccaggcttaggaacgtagtggtagtacttaaggttttacttagttacggttaactaaacgtaaatttactttaatttacgtaaaccgttttcggtagggttaacccgtttccggaaccggtaaacggggtaaccctaaggggttacgggtaacttaacgtacgaaaggtaccgtaaacgttggtacgggtcctaggtacccg

SEQ ID NO: 278977 - DNA, 537 bp, Homo sapiens
  misc_feature: GYAE6OF02FS0S3.19.71.G05.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatagaaaactacttagcttggtaccagcagagaccaggacagcctcgtagctgctcatttacnggcatctaccggatccgggtcctagaccgattcagtggcaggcgggtctgggacagtatttcactctacaccatcagacacgctcgcgagctagaagattggaggtctagtttacttagttgttaccaaataattatttaattaacttacttcggtgtaccgttcggaccgtaagggtaccaagggtacatatcgacgtacgtaacgttgtcggtctagaccg

SEQ ID NO: 278978 - DNA, 524 bp, Homo sapiens
  misc_feature: GYAE6OF02HFX8H.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatccgtacccgggaatcccggggtccctgaccgattcagtggcaggcggtctgggacagtatttcactctcacatcagcngcctgcaggctagagntgtgctagtttattattgtactaactaattattattattacttcgtcgtacgttcgaccgtaagggtaccgaaggttgaatatcgaagacgtaacgtggtggtctgtaccc

SEQ ID NO: 278979 - DNA, 552 bp, Homo sapiens
  misc_feature: GYAE6OF02GJJDB.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatcgtacccggaatccggggtccctgaccgattcagtggcagcggtctgggacagntttcactctcaccatcagcagcctgcaggctgaagntgtggctagtttatattgtacaaactaattatttaattatacgtttcgtaggtacgttcggaccgtaaacggggtacccgtaaagggtcggtaacttaagtcgaaggtaccggtaaacgttggtacgggtaccttgaaccccg

SEQ ID NO: 278980 - DNA, 549 bp, Homo sapiens
  misc_feature: GYAE6OF02GO5M4.19.71.G05.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggccacgatcaactgctaagtccagccacaatctttanacagttccaacaatagaaaactacttagcttaggaccagcagacgaccaggacacgcctacctaggctgctcattcgnggcatctaccggatccggggtcctgacctattcgagtgcagcgggtcnggacngtatttcactcacacatcgancacgctgcgacgctagagcgtggtgtactagtttatagttacgtactaaactagttattagtttactacgtttacgtacggttacgttaccgacgtaacggtacgtaaggtgtaactacgtacgaacgtaccgtagttcggtcggtacgtcgtaaccg

SEQ ID NO: 278981 - DNA, 604 bp, Homo sapiens
  misc_feature: GYAE6OF02ITNL3.19.71.G05.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
tcagtactctcgtgcacgaccggtgctcgatttagtgtcgtcgcaagagagagggggagggtacgaacaggcaggcaggggcgagcaagatggtgttgcagacccaggtcttcatttctctgttgctctggatctctggtgcccacggggacatcgtgatgacccagtctccagactcactggctgtgtctctgggcgaggccgggccaccatcaactgcaagtccagccaacaatcttttanacngttccaacaatagaaaacctattagcttggtaaccagcagagaccaggacngcctccaggctgctcatttcgnggccatccgaccgggaattcccgggtcctagacctnttaccaggtcgcaggtcggtctgggacaggtatttccactctacacctatcagcacgtctgctggactagaacgtatggtcggtactagttttattaacgttgtacgaaacctagtttaactttaattacgttaacttcggtaggttacggttacccggtaacccggaacgggtaaacccgtaacgggttaaggtacttaacgttaccgaacggtaaacccggtaagtcgggtttacggaccttaccgg

SEQ ID NO: 278982 - DNA, 602 bp, Homo sapiens
  misc_feature: GYAE6OF02IMACX.19.71.G05.1.454.CMB.1.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcagtccagccacaatctttatacagttccaacaatagaaaactacttagcttggtaccagcagagaaccaggacagcctcctaggctgctcatttacnggcatcgtaccggaatccggggtcctgaccgtnttcagtcggcgaggccgggtctggggaacagtacgtttccacgtactccaccattcgacgcacggacctgaccgaggtctaggaaacgtgtcggtacggactaaggtttattacgttagtacctaaacgttaattagtttaatttagttaccgtttcggtacggtaaccgttcgggaaccgtaagggtaacccggtaagggtcggtaagttagtaccgtacggaacggtaccgttggtacgggaccttaggtacccg

SEQ ID NO: 278983 - DNA, 768 bp, Homo sapiens
  misc_feature: GYAE6OF02J3B12.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtcgtcctgtcacaagtacagctgcagcagtcaggtccaggactggtgaacgccctcgcacgaccctctcgctccacctggtcnccagtccgtccggggacaggtacgtcgctaacggcgacgtacgttggttcgtcgttagggccgtacggtcgggtaccgacggacctaccggtccccgtaagtcggacggtacggttaccgtaaggtacggggtgggcggttaacgggggaaacggtacctaatttacgtttacctaggtaccgttacccgaaacggtacggtaaggttaaactaaccgttaaattcacggacctacgtacgttccgtttagggttacgaacgggttacgtaccgggtaacgttaacggaaactaaccgttaaccgaaacccgggttaacggaaaccctaacgtaacggttaaccggaaaccgttaaacccgttcggttaccccttacccgtacgaccgtaccgtccgttaccgtacccgtttcgtagtacccggtacccggtaccggtaacgggtcccggttaaggtaccgtttaaagttaacggttacggttaacgggacgggtaaaccggcccggtaaccccgtagtaaccgtaccg

SEQ ID NO: 278984 - DNA, 542 bp, Homo sapiens
  misc_feature: GYAE6OF02G0AAI.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttaggtaccagcagagaccaggacagcctcctaggctgctcatttacnggcatcctacccgggaatccggggtcctgaccgtattcagtggcaggcgggtctgggacagtatttcactcncacatcagcacgcctgcaggctagaagtntggtgtactagtttattagttgactaataattatttattattacttcggtagtaccgttcggaccgtaagggacctaagggtcgaagttaactcgaacggtaccgtaagtggtacggtctggtaacc

SEQ ID NO: 278985 - DNA, 539 bp, Homo sapiens
  misc_feature: GYAE6OF02GD6SA.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcattacngggcatccgtaacccgggaatcccggggtccctgaccgtattcagtggcaggcgggtctgggacagtatttcactctcaccatcagcacgcctgcaggctagaagatggtgctagtttattattagtacaaactaattatttattattacttacgtggtaccgttcgaccgaagggaacctaagggtgaattactacgaaggacgtaacgtggtggtactgtaccg

SEQ ID NO: 278986 - DNA, 534 bp, Homo sapiens
  misc_feature: GYAE6OF02GPORN.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcaactgcaagtccagccacaattcttttanacagttccaaacaatgaaaactacttagcttggtaccagcagagaccaggacaggcctcctaggctgctcatttacngggcatctacccgggaatcccggggtcctgaccgattcagtggcaggcgggtctgggacagtatttcactctcaccatcagcncgcctgcgagctagaagntgtggctagtttattagttgactaagtaattattaattactacgttcgtaggtaccgttcggaccgtaacgggacaagggttggaattgtacacgacgtaagtggtggtactgaaccg

SEQ ID NO: 278987 - DNA, 728 bp, Homo sapiens
  misc_feature: GYAE6OF02JVBBA.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagaaccaggtcttcatttctctgttgctctggatctctggtgcccgacggggacatcgtgatcgacccagtcctccagacctccctggctgtgtctctgggcgaggccggccaccatcaactgacaagtccagccaactaacttcttttaacactacgttaccaaactaatacgaaaactacttacgtcttaggtaaccagacaagacgaacacggacagccctacgtacggctgccttactaatttacgcgggacctacgttacccggtaacccgggtaacgttccccggggtaccctacggaacccggtattcggaaggttcggacgagggtccgggtcgtacggggaactaggtactttccacgtccgttaccaacctacgtccgaacgtcgtaccgtccgtacgacggtacggtacgtacgtaagtacgtacggttacgtactttaaggttttaactttacggtttacgtaacctaaaacgtttaatttaacgtttaatttaaccgttaccgtttaccggggtttacgtaaccggttaccggaaccgggtaacggggtaaccgttaaggttagtaacgttagtaaccggaacgtaacggttacgtacggtcgtaccgtagtaacccg

SEQ ID NO: 278988 - DNA, 548 bp, Homo sapiens
  misc_feature: GYAE6OF02HMA8T.19.71.G05.1.454.CMB.1.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactcttagcttggtaccagcaganaccaggacagcctctaggctgctcatttacnggcatcgtacccgggaatccggggtccctgaccgattccgagtggcaggcgggtctgggacagtatttcactcacaccatcagcancctgcaggctgaagntgtgctaggtttatattgacaaactattattattatactttcgtagtaccgttcggacgtaacggggacctaaaggggtgtaacttacgtacgtaacggtaaccggtaaccgttggttacgggtactcggtaaccc

SEQ ID NO: 278989 - DNA, 550 bp, Homo sapiens
  misc_feature: GYAE6OF02I7ZGO.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacgagtgttgcttggcacgtggtcaggcacgtcccatcgagaggtctagaggtggcgtagggaaggactagtatttcgatgtaccaactacggtaggtaaactaactaaattatcgacacctaatcttaggttgaaggtagtacgactgaacaatacgaacgtacgacacatacgaacgaacgagttacctcctgctacgctacgtacctctgtacgaccgtaccgacggacgtacggtagtagttacgttacgtacggtaggaacgacgaccccgtagtacgtaacg

SEQ ID NO: 278990 - DNA, 593 bp, Homo sapiens
  misc_feature: GYAE6OF02JILHH.19.71.G05.1.454.CMB.1.raw
  modified_base (173)..(173): a, c, t, g, unknown or other
  misc_feature (173)..(173): n is a, c, g, or t
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggagggtacaacaggcaggcaggggcgagcaagatggtgttgcagacccaggtcttcatttctctgttgctctggatctctggtgcccacggggacatcgtgatgacccagtctccnactccctggctgtgtcctgtgggcgagcgggccaccatcaactgcaagtccagccacaattcttttanactacgttccaaacaatagaaaactacttagcttggtaccagcagacgacagacacgcctccgtagctgctctatttacgnggcataccgtacccgggattccccggggcctacggaccgtacttccgaggtcgcacgggtcgggtcctgggacagtacgtttcactctacnctatcacgacacgctagctacggctacgagtatggtacgcgtaagtttatttagttactactaaataattactttaattacgttagttcgtacggtaccggttcgtaacggaccgggtaacgtaaggttggtaacgtacgtaacgacgtaacggtaacttcgggtaacgtcgtacggtcc

SEQ ID NO: 278991 - DNA, 613 bp, Homo sapiens
  misc_feature: GYAE6OF02GNBIR.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattctttanacagttaccaacaatagaaaactacttagcttggtaccagcagagaccaggacagcctcctaggctgctacatttacgnggcatccgtacccgggaactcccggggtccctgaccgtattcaggtggcaggcgggtctgggacagtactttcactctcacctatcagcagcctgccgaggctgaacgtgtggtggtcttagtttattattacgtactaaactaattatttaattaactacgtttcgggtacggttaccggttaccggtacccggtaaacggggaacccgttaaaggggttcggtaaactttaaccggtaccgtaaacgggtaaccggttaaacggttcgggtacggtaccgtacggtaacccgg

SEQ ID NO: 278992 - DNA, 603 bp, Homo sapiens
  misc_feature: GYAE6OF02IVU10.19.71.G05.1.454.CMB.1.raw
  modified_base (241)..(241): a, c, t, g, unknown or other
  misc_feature (241)..(241): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgacaagtccagccacaattcttttanacagttccaacaatagaaaactactagcttggtaccagcaganaccaggacagcctctaggctgctatactttacgnggcactccgtaccgggatcccggggtcctagaccgtattcgagtcggcgaggcggtctggacngtattcactctacactntcagcagtcctgcacggctagagtgtgtcggtacttagtttattattacgtaactaaacttaattatttaattaacgttacgttacggttacgggtaccgttaccggaacccggtaacgggtaacccgtaaggggttacggtaagtttacgtaaccgtaacggtaaccggtaaaccgttgggttacggtccgttacggtaacccg

SEQ ID NO: 278993 - DNA, 606 bp, Homo sapiens
  misc_feature: GYAE6OF02HUW3A.19.71.G05.1.454.CMB.1.raw
  modified_base (239)..(239): a, c, t, g, unknown or other
  misc_feature (239)..(239): n is a, c, g, or t
  modified_base (384)..(384): a, c, t, g, unknown or other
  misc_feature (384)..(384): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaatcttttanacagttccaacaatagaaaactacttagcttgtaccagcagagaccaggacacgcctcctaggctgctctatttacgtgggactagtacctacccgggaatcccggggtaccctggaccgtattcgagtcggacaggcggtacgngggaacagtactttcactctacacatcaagcagcctagcgaggctagaacgtagtgagtcttaggtttacttagttacgtacaaaacgttaattatttaactttaacttaccgtttacgggttacggtaaccggtttaccggaaccggtaaacgggtaacccgtaagggttacggaattaacgtacgaacggtacgtaacgtggttaacggctacggtaacc

SEQ ID NO: 278994 - DNA, 619 bp, Homo sapiens
  misc_feature: GYAE6OF02G5SIW.19.71.G05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccgatcaactgcaagtccagccacaatcttttanacagttccaacaatagaaaacttacttagcttaggtaccagcagagaccaggacagcctcaggctgctctagtttacgnggctacgtccgtaacccgggtagttcccggggtaccctggaccgtatcgaggtcgcgaggcggtcgtggacagtactttccactcctcactactacacgcctacgcccgtgccgtaggtcctaggaacgtagttgggtacggtacttaaggtttacttaggttacgtactaaacgtaatttatttactttaagtactttacggtacggttacgttccgggtaacgtaacggggtacccgtaagggtacgtaacgttacgacggtaacgtaacggtacgttcggtaggtcgtacgtaaccg

SEQ ID NO: 278995 - DNA, 668 bp, Homo sapiens
  misc_feature: GYAE6OF02HIT1M.19.71.G05.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattcttttanacagttaccaanaatagaaaactacttagcttaggtaccagcagacgaccaggacagcctcctaggctgctctatttacngggcagtccgtaacccgggaactcccggggtccctaggacctattccgaggtcggacgagggtccgggtacgtaggggacaggtacttttaccgacttcctaccaaccataccaacggcaacgcctggaccgaaggcctaagaagtagtggtacgtcttaagtttttaactagtttacgtaacctaaaacgtaatttaactttaacgtttaaacttaccgtttacggttacgggttaacccgtttacccggggaaccggtaaacgggggtaacccttaaagggttacggtaattaacgtaccgtaaccggtacggtaacggttgggtaccggtacgtacgtaaccccg

SEQ ID NO: 278996 - DNA, 698 bp, Homo sapiens
  misc_feature: GYAE6OF02J1ZP7.19.71.G05.1.454.CMB.1.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
tcagtactctcgtgcacgaccggtgctcgatttagtgtcgtcgcaagagagagggggagagtctgctgaattctggctcgaccagggcagtcaccagagctccagacaatgtctgtctccttcctcttcttcctgcccgtgcgtgggcctcccacaaggtgtcctgtcacaagtacagctgcagcagtcaggtccaggacgtggtgaacgccctcgcacgaccctctcgctcacctgtcnccatccgtccggggacagacgtcgctagcgacngtgttgcttaggctacgtggtcaggcacgtccccagtcgagngtctagnggtggcgtagggaacgactatgttcagtcgtaccgaactacgtaggaacttaactaaagttactacgtactaaccctagttccgttaggtttagaacggtacgttaccgtaacgttacggtaaactaaagtaccgtaaacggttaacgaaaccgtaacctaaggtaaacccgtaaaacggtaaacccttaaccggttttaccctaccccggttaagtacccgtaaccggttaccttacccggtaacccgttccgttacgttaccgtacccgtacccgggtaacgggtaacccggttacgggttaacgtttaacgttaaccgttacggttacggttaacggtaaccggtacccggtacccctaagtaccgtaaccgg

SEQ ID NO: 278997 - DNA, 611 bp, Homo sapiens
  misc_feature: GYAE6OF02I0SS3.19.71.G05.1.454.CMB.1.raw
  modified_base (242)..(242): a, c, t, g, unknown or other
  misc_feature (242)..(242): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccaacaattcttttanacagttaccaaacaatagaaaactacttagcttggtaccagcaagagaccaggacagcctcgaggctgctctatttacngggcatcgtacccgggactccggggtcctcgaccgtattcgaggtggcgacggcgggtcgtggggactagtactttcactcctccactatcagcacgcctgcgagctagagtagtggtacggctaagttttattattagtactaaactaagttaatttatttaacgttacgtttacggtacgggttaccggttacggtaaccggtaaacggggtaacccgtaaaggggttagtaacgttagttaaccgaacggtaacgtaacgttaggtacgggtacgttacgtaacccg

SEQ ID NO: 278998 - DNA, 729 bp, Homo sapiens
  misc_feature: GYAE6OF02JC48P.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctcccgtggctgtgtctctgggcgagcggccacatcaactgacagtccagccacaattctttanacacgttaccaacaatacgaaaactacttagctagtaccagctagacgacaggacacgcctacgtaggctacgctactacgtttacgcggctacgtacgtaacccggaacgtcccggggtaccctacggaccgtacttacgacggtcggacgtacgggtccggggttacgtacggggaacgtacggtacttttaccgacgtaccttaccaacctagtccgaacgtccgaacgtcccgtgaccggtacggtacgtacggaaacgtaggtggttcggtacgttaacggttttaattaaccgtttacgtaaccgtaaaccttaaagttaacgttttaatttaaaccgttacgttacgggttacgggtaacccgtttcggggtaaccggtaaacggggtaacccggttaaaggggttacggttaaacgttacgtaacggtaaccggtaaaccggttacgttaacggggtacgggttaccgtaccggtaacccgg

SEQ ID NO: 278999 - DNA, 548 bp, Homo sapiens
  misc_feature: GYAE6OF02GXGAW.19.71.G05.1.454.CMB.1.raw
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagtcttaggtaccagcagacgaccaggacagcctcctaggctgctcatttactgggcatccgtacccgggatcccggggtccctgaccgattcagtggaacgcgggtctgggacagtattcacgtctcaccntcagcagcctgcaggctagaagtntgtcgtctagtttatattgactaatattattattaattaccttggtagtacgttccggacgtaagggtactaaggggtataagtacgtacgtaaggtacgtaacgtggtaggtacctggacctaaccg

SEQ ID NO: 279000 - DNA, 677 bp, Homo sapiens
  misc_feature: GYAE6OF02HV19Q.19.71.G05.1.454.CMB.1.raw
  modified_base (243)..(243): a, c, t, g, unknown or other
  misc_feature (243)..(243): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagactcctgctgtgtctcgtgggcgagcggccaccatcaactgacaagtccagccactaattcttttaanacctagttaccaaacaatagaaaaacttacttagtcttacggtaccagcagacgaccaaggacagccctaccgtagggctacgcctactaactttacgtcggggactaacgttccccgtaaacccggggtaagttcccccgggggtacccctgggaacccgttagttaccgaaggttcgggaccgtaggggtccgggttcgtacggggaactacggtactttacccgacccttacgaaccctacgtacgtacgacgtcgccttacggcgacgcgtaaggagtactgggtcgactagttttaattattcggtataacgtaattaatttattactttaacgttcgtacggtacgttaccgtaccggaacggtaaccggtaaggtaggtaactacgtacaggtaacgtaggttacgagggtacctgtaccgtaaccg

SEQ ID NO: 279001 - DNA, 539 bp, Homo sapiens
  misc_feature: GYAE6OF02ID2NY.19.71.G05.1.454.CMB.1.raw
  modified_base (220)..(220): a, c, t, g, unknown or other
  misc_feature (220)..(220): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctccacaaggtgtcctgtcacaagtacagctgcagcagtcaggtccaggactggtgaagccctcgacagaccctntcgctcacctgtcgccatccgtccggggacagacgtcgactagcgacagtgttgcttgcacgtgggtcagggcacgtcccagtcgagcggtctagnggtggctaggggaagactatattcgatcgtaccaacacgtagaatactaaattcgtcgacacatcgtagtgacgtagtacgactagtaactaatacgtaacgtagacacagtacgaaacgactacgttacctcctgcgacgctcgactcgtgtcgtacgtccggaacgtacgacgtaggtatagttacttacgtcggtaggaacgtcggacccctagtaaccg

SEQ ID NO: 279002 - DNA, 518 bp, Homo sapiens
  misc_feature: GYAE6OF02FHQ6T.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanactagttccaacaatagaaaacttacttagctttggtaccagcagagaccaggacagcctcctaggctgctcatttacnggcatccgtacccgggaatccggggtccctgaccgattcagtgcaggcgggtctgggacagtatttcactctcacntcagcagcctgacgaggctagaagtgtgtgacttagtttattagttgtacaaataattattattatacttgtgtacgttcgacgaggacctaggtgtatagtacgagacgaattggtgctgacc

SEQ ID NO: 279003 - DNA, 596 bp, Homo sapiens
  misc_feature: GYAE6OF02FWQ1K.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtgggtcaggcacgtccccagtcgagaggtctaggagtggcgtggggaagacagttattcattcgtaccaactacggtaggaaactaactaaagttactgactaaccagtcgttagttacgagtacgtacgactacgaactaactacgaaacgtacgactaacagtacgaaacgtaacctacgttacctccgtagacgacgtctacgtaccttcgtacgtaccgtaccgtaccggtacggtaccgtaacgggttagttaacgttacgttacggttacggtacgggaacggtacccggacccctaagtacgtaaccg

SEQ ID NO: 279004 - DNA, 544 bp, Homo sapiens
  misc_feature: GYAE6OF02FZ91H.19.71.G05.1.454.CMB.1.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (423)..(423): a, c, t, g, unknown or other
  misc_feature (423)..(423): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtgccatctccgggggacagagtcgctagcgacagtgttgcttggcacgtgggtcaggcacgtccccatcgagnggtctagagtggcgtgggaagacatattcatcgtaccaactacgtaggaataactaaattanagacacctatctgttgagtagtcgactgacaatacaacgtagacacatacgaanaacctagttacctccgtgctagctacgacctctcgtcgtacccgtacccggaggtaaccgacgggttcgtaattacgtttacgtcggtagggaaccgaccggtacccctagtacgtaaccg

SEQ ID NO: 279005 - DNA, 620 bp, Homo sapiens
  misc_feature: GYAE6OF02GWCBW.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaagccctgcagaccctctcgctcacccgtgtcgccagtccgtccgggggacaggacgtcgctagcgacagtgttcgcgttggcacgtgggtcaggccacgtccccagtccgaggacggtctaggagtggcgtaggggaagactagttatttcattcgtaccaaacgtacgtagtaaataacgtaaattacgcgacaaccgtatcgtagttagagtacgtacgactagaacactacgaacgtacgaacgactaacgtacgaactaaccgtagttaccctaccgtacgaccgtacgtcctaaccgtaccctcgtagtaccggtaccgtacccggaacggtaccggtacgggttagttaacgttagtttaaccggagggttacgggaaccggtacccggaaccccgttagaaccgtaaccg

SEQ ID NO: 279006 - DNA, 588 bp, Homo sapiens
  misc_feature: GYAE6OF02GM8EU.19.71.G05.1.454.CMB.1.raw
  modified_base (237)..(237): a, c, t, g, unknown or other
  misc_feature (237)..(237): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacatctttanacagttccaacaatagaaaacttacttagcttggtaccagcagagaccaggacagcctccaggctgctcatttacgnggcatcgtacccggagtccggggtcctgaccgtattcgagtggcaggtcgggtctgggacagtactttcactctacaccctatcgagcacgtccgtgaccaggtctagaacgtatcggtaggacttaggttttattattgtaactaaactaatttatttaatttattaaccgtttcggtacgttaccgttccggggtacctaaacggggtaaccgtaagggtaaggtaattacgtacgtaagtaaccggtaacgttgggtacggcgttcgaccc

SEQ ID NO: 279007 - DNA, 609 bp, Homo sapiens
  misc_feature: GYAE6OF02I9SX1.19.71.G05.1.454.CMB.1.raw
  modified_base (243)..(243): a, c, t, g, unknown or other
  misc_feature (243)..(243): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (508)..(508): a, c, t, g, unknown or other
  misc_feature (508)..(508): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcccgtggctgtgtctcgtgggcgagcgggccaccatcaactgacaagtccagccactattctttanactagttaccaacaatagaaaactcttagcttcggaaccagcagagaccaggacacgccctcgtagcctgctctaagtttcgaggtcacgtccgtaacccgggagttcccggggtaccctagaccgaagttcaaggtcggcgtaggtcgggtacgtcgggaactacggttactttccgacctcgtacaacctntacgacgcacgtctacgngtacggtctaaggaacgtgtcggtagtacgttaacgtttgtttacgtacgttanaaaaccgttatttaatttacttacgttcgttacgtcggtacgttacgtaaccggaggtaaccgtaggtagatacgtcgaagactcgtagtcgacgtgtacg

SEQ ID NO: 279008 - DNA, 737 bp, Homo sapiens
  misc_feature: GYAE6OF02HNF55.19.71.G05.1.454.CMB.1.raw
  modified_base (249)..(249): a, c, t, g, unknown or other
  misc_feature (249)..(249): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatcgacccagtctccagactccctggctgtgtctcgtgggcgaggcgggccaccatacaactgacaagtccagaccaactaattcttttaanacctacgttaccaaactaatacgtaaaaactacttaagacttaggtaacccagccaaggaacgaccgaaggtaaccacgtccctaccgtaggcctgacctctaactttacggtggactacgtacccgtaacccgggaacgttcccggggtaccctaggaacccgtagtttccgaaggttcggacgtaacggtccggggtactacgggggacctaaggttacttttaccgacctttacccgtacaaccgtaacgttcgaacgtaccgaacgtccctagaccgtagggaccgttaagaaggtattcgggtaagtacctttaagtttaattaacgtttacgtaacctaaagttaaactttaacgttttaatttaaccgttagtttaccgggtagtaccggttacggaacccggtaacgggtaacgtaacgggttagtaacgttaacgtacgaaggttaaccggaacgttgggtaccgtacgtacgtaaccg

SEQ ID NO: 279009 - DNA, 515 bp, Homo sapiens
  misc_feature: GYAE6OF02JC31L.19.71.G05.1.454.CMB.1.raw
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttacnggcatctacccgggatccggggtcctgaccgattcagtgcagcgggtctgggacagtatttcactctcaccatcagcagcctgcagctagagagtgtgctagtttacttatgtacaactaattattattactacttgtgtacgttacggcgtaacgggtaccaaggtggaattagtacgagtacgtacgtggtcggtctgtacc

SEQ ID NO: 279010 - DNA, 593 bp, Homo sapiens
  misc_feature: GYAE6OF02HY4Y5.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaagcctcgcagaccctctcgctcacctgtgccatcgtccggggacagagtcgctagcgacagtgttgcgttggcacgtgggtcaggccagtccccatccgagacggtctaggagtggcgtggggaaggacattatttcattcgtaccaaacgacggtaggaaattactaaaatttagtacgaccacctattccgttgttagagagtaccgtactagactaatacaaacgtagaaccactaataccggaacgtaaaccacgttaccttacccgtagacacgtcgtacgaaccttcgttagtacgtacctccccggaagggtaccgtacgggttcgtaacgttaacgttacgtggttaacgggacggtaaccggaccccctagtacgtaaccg

SEQ ID NO: 279011 - DNA, 586 bp, Homo sapiens
  misc_feature: GYAE6OF02IKSXF.19.71.G05.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (332)..(332): a, c, t, g, unknown or other
  misc_feature (332)..(332): n is a, c, g, or t
  modified_base (442)..(442): a, c, t, g, unknown or other
  misc_feature (442)..(442): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcagtccagccacattctttanactacgttaccaanaatagaaaacttacttagcttggtaacccagacaagacgacccaaggaccaacgccctaccgtaggcctgctctatttacgngggctagtaccgtacccgggtaagtcccggggtccctagaccgtatcgagtggcaggcggtctggacagtatttcactcgacaccatcagcacgcctgcaggctagaagngtagtgactagtttattattacgtacaaattaattatttaattacttacgttacggttgtaccgttccgggaaccgtaacggggtaaccgtaaggtacgtaagttactacgaaggaaccgtacgtaggtcggtctacgtaaccc

SEQ ID NO: 279012 - DNA, 753 bp, Homo sapiens
  misc_feature: GYAE6OF02GKIFG.19.71.G05.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcggccaccgatcaactgcaagtccagccanaattctttanacattccaacaatagaaaactacttagcttaggtaccagcagacgaccaggacagcctctaggctgctactatttacgnggtcacgtaccgtacccgggtaacgtcccggggtccctaggtaccgtattccgaggtcggaccgtaaggtccggggttctaggggacctaggttaccttttaccgaaccttaccgttaccgaacctaacgtcgaccggacctaacggtcctacggacgtacggtaccttaaggaacgtaagttcgggtaagttaccgtttaaagtttttaacgtttaagtttaccgtaaacctaaacgtttaaactttaacgttttaaacgttttaacttaacggtttaccggttaacggggttaacccggtttaccgggtaaacccggtaaacggggttaaaaccccgtaaggggtttaaccggtaaaactttacggttaaaccggtaacggtaacccgggtttaaacgtaccggggtttacggtaccgttaccggtaacccg

SEQ ID NO: 279013 - DNA, 550 bp, Homo sapiens
  misc_feature: GYAE6OF02G9FG9.19.71.G05.1.454.CMB.1.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttgtaccagcaganaccaggacagcctcaggctgctcatttactgggcatcctacccgggaatcccggggtcctgaccgattcagtggcaggcgggtcgtcgggacagtatttcacctctccaccatcacgcacgcctgcaggcttagaagatgtgtctagtttattagttcgtactaaactaagttactttattacttacgttacgtacgtacgttcgaccgtaacgggaccgtaaggtcggtaatacgtacgaaggtaccgaacgtggtcggtactgtaccc

SEQ ID NO: 279014 - DNA, 755 bp, Homo sapiens
  misc_feature: GYAE6OF02G2GNW.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcagggcgagcggccaccatcaactgcaagtccagccacaattctttanacagttccaacaatagaaaactacttagacttaggtaccagcagagaccgagacagcctccgtaggctgctactagtttacgtgggctacgtaccgtaacccggggaacttcccgggggtacccctaggacccgtatttccgaggttcggacgtaacgggccgggggttactacggggaaccaacggttactttttaccgaccgttccctaccgaaccctacgttaccaaggtaccctacggtacccttcgggaccgtaagggtccgttaacggaaacgtacgttcgggtacgggtaccgtttaaggtttttaactttaacgttttacggtaaccgtaaaacttaaagttttaacgttttaaattttaacgtttaaaccgttttccgggttaacgggttaaccggtttacccgggtaaccggtaaacggggtaacccggttaagggttacgggtaaacttaacgttaccggtaacggtaccggtaaacggttcggttacgggtaccgtaggtaacccg

SEQ ID NO: 279015 - DNA, 532 bp, Homo sapiens
  misc_feature: GYAE6OF02GWJKH.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctaccgggaatcccggggtcctgaccgattcagtggcagcgggtctgggacagatttcactctcaccatcagcagcctgccnggctgaantgtgctagtttattatgtactaaactaagttaattattaacttactttcgtaggtaccgtttcgggacctaaggggaacctaagggtgtaatacgtacgagtacgaacttcggtgggctggacc

SEQ ID NO: 279016 - DNA, 528 bp, Homo sapiens
  misc_feature: GYAE6OF02GHEVT.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttatctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacnggcatccgtacccgggatcccggggtcctgaccgattcagtcggcaggcgggtcngggactagtntttcactctcaccatcagcagcctgcaggctagaagtgtgtggactagtttattagttgtacaataattattattactacttgtgtacgttcggacgtaagggccaaggtgtaatacgtcgaagtacgtaacgttggtacggtctcgtacc

SEQ ID NO: 279017 - DNA, 552 bp, Homo sapiens
  misc_feature: GYAE6OF02JHPSG.19.71.G05.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaanatagaaaactcttagcttaggaccagcagacacccgtagacacgcctacctaggcctgctctatttacgnggcatccgtacccgggatcccggggtcctagaccgtattcgagtcggcagggtcggtctggggaccagtactttccatccacacntcacgctacgcctgacagctggaantgtgactagtttatattcgtacaanaattagttatttactcgttacgtgggtacttccggaccgtaagggtacgtaaggtagtaattacgagtaacgacggtaccaggttccggataccgtacgg

SEQ ID NO: 279018 - DNA, 590 bp, Homo sapiens
  misc_feature: GYAE6OF02H3CWZ.19.71.G05.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaatcttttanacagttccaacaatagaaaactacttagcttggaccagcagagaccaggacagcctcctaggctgctcatttacgnggcatcgtacccgggaatccgggtcctgaccgtattcgagtcgctagcggtacgtcggacagtactttcacgtctcaaccatacgacgacacgctgacaggtctaggaatagtgtacgtactaacgttttattacgttacgtaactaaacttaaattactttaacgtttaactacgtttacggtagggttaccggttacggtacccgtaacgggaaccgtaagggttgaacttacgacgaacggtaaccgtaacgtcggtacgtcgtacgtaacc

SEQ ID NO: 279019 - DNA, 578 bp, Homo sapiens
  misc_feature: GYAE6OF02F4TWY.19.71.G05.1.454.CMB.1.raw
  modified_base (332)..(332): a, c, t, g, unknown or other
  misc_feature (332)..(332): n is a, c, g, or t
  modified_base (449)..(449): a, c, t, g, unknown or other
  misc_feature (449)..(449): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtccagccaacaattcttttaatactacgttaccaaacaatacgaaaactacttagactttacggtaaccaagcagacgaccgaagacagcctctaggctcgctcatttacngggcatccgtaccggtaacgtccggggtccctgaccgtatccgagtcggcacggcggtcgtggactagtactttcactctcaccatcagcacgtctcgacgagtcgtagaagtgtgngacttagtttacttattcgtaactaacttaattaatttaattacttacgttcgtaggtaccgttccggacgtaacgggaacgtaaggtaggtactagtacgaacggtactacgtgtacggtctagtacc

SEQ ID NO: 279020 - DNA, 690 bp, Homo sapiens
  misc_feature: GYAE6OF02IQHQ8.19.71.G05.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (317)..(317): a, c, t, g, unknown or other
  misc_feature (317)..(317): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
tcagtactctcgtgcacgaccggtgctcgatttagtgtcgtcgcaagagagagggggagggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatcgaactgacaagtccagcactaattctttanacattaccaacaatanaaaactctagtctaggaccagacagaacgaccgaggaccaggacctcgtacggctcgtntactaactttacgagggactacgtaccgtaaccggggaacttcccggggtacccgtacgaaccggtattaccgaggtacggcgaacggtcgggtacgtgggaacgtagtagtttccactctccaaccntcgacgactcgcctacggtanacgggtcctaaggagtaacgtcgggtacgtacgtaggttttaacttaagttaccgtaacgtaaactaaagtttaacgtttaataccgttttaagtaccgttacggggtaccgttaccgggtaaccggtaaacgggggtaaccttaacggggttaaggtaaacgttacgaacgttaaacgggaccgttaaacgggtcggttaacgggttcccgaatttaacccgg

SEQ ID NO: 279021 - DNA, 619 bp, Homo sapiens
  misc_feature: GYAE6OF02FH476.19.71.G05.1.454.CMB.1.raw
  modified_base (340)..(340): a, c, t, g, unknown or other
  misc_feature (340)..(340): n is a, c, g, or t
  modified_base (445)..(445): a, c, t, g, unknown or other
  misc_feature (445)..(445): n is a, c, g, or t
tcagtactctcgtgcacgaccggtgctcgatttagtgtcgtcgcaagagagaggggggaggtacaacaggcaggcagggcagcaagatggtgttgcagacccaggtcttcattttctctgttgctctggatctctggtgcccacggggacatcgtgatgacccagtctccagacctccctggctgtcgtctcgtgggcgagccgggccaccatcactgcaacgtccagccactaacttcttttacactacgttaccaaactaatacgaaaccttacgttagcctttacggaccagcaagacgaccaggacacgcctcgtaggctcgctactactttacgnggacctacgtccgtaaccggacgttcccggggtcctagaccgtattcgacggtcggacgacggtcgggtacgtacgggacctagtactttccactcctcacctancacgcacgcctgcaggtctagaagtcgtcgtacgtacttagttttaattactacgtaactaaattaacttaagtttactacttacgtcggtacgtaccgttcggaaccgaacgggtaacctaagggtacgtaacttacgacgtacgtaaccgtaacgtcgtcggacttaggacc

SEQ ID NO: 279022 - DNA, 605 bp, Homo sapiens
  misc_feature: GYAE6OF02I75QA.19.71.G05.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgccacggggacatcgtgatgacccagtctcagactcctggctgtgtctctgggcgagcgggccacgatcgaactgcaagtcagccacaattctttanacagttccaanatgaaactctagcttgtaccngcaganaccaggacagtcctcgtaggcttgctcatttacnggcatcgtaccggaatccggggccctgaccgtattccgagtcggcacggtcgggtctgggacagtactttcactctctacatccagacacgctcgacagggcttagaagtagtggtagccgtagttttacttagttcgttacaaacgttattaacgttaactttaacgttaacctttcggtaacgggtacccgtttacgggtaccgtaaacgggggtaacccttaaaggggttacggtaaagtttaacggttccgaaaggtaccggttaaacgttgggttacggtaccgtacgtacccg

SEQ ID NO: 279023 - DNA, 671 bp, Homo sapiens
  misc_feature: GYAE6OF02GOU0O.19.71.G05.1.454.CMB.1.raw
  modified_base (164)..(164): a, c, t, g, unknown or other
  misc_feature (164)..(164): n is a, c, g, or t
  modified_base (245)..(245): a, c, t, g, unknown or other
  misc_feature (245)..(245): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccngtctccagctccctggctgtgtctcgtgggcgaggcgggccaccatcaactcgacaagtccagaccaactaattcttttanactacgttaccaaactaatacgaaaacttacttagaccttggtaaccagcaagacgaccgaaggacagtccctacctaggctgctactacgtttacgcggactacgtccgtaaccgggacgtcccggggtaccctcggacctattccgaggtcggacacgggtcggtcgtacgggactacgtactttccgacctctaccacctactacgacgcacgtcgtgacgtacggtcgtaggagtagtcggtcgtaagtttagttttaacgttagttacgtaactaaagttaagtttaactttaactttaggttaaccttaccgggtacgggttaccgttaccgggaccgtaaacggggtacgttaacgggtacggtacttaacgacgtaacggttaaccggtaccggtttggtacggtacgtaccgtaccg

SEQ ID NO: 279024 - DNA, 777 bp, Homo sapiens
  misc_feature: GYAE6OF02IJNEZ.19.71.G05.1.454.CMB.1.raw
  modified_base (123)..(123): a, c, t, g, unknown or other
  misc_feature (123)..(123): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgntctggatctctggtgcccacggggacatcgtcgatgacccagtctccagactccctggctgtgtctctgggacgagccgggccaccgatacacgtcgcaagtccacgccactaattcttttanacacgttcaaccaatanaaacgttactagctttaggaccagctaagcgaacccgtagacaccgtctacccagggtntacgcgtactaagtttaccgngggtaccaacttcccgaacccggggtaacgttcccgggggtccccttaagacccgtacttacgccgtagggcgaacggcggggtttccctaggggaacctacggactttttcgacccgtactaccgtacctaacgttaccgtacgacgtaccgtcccgttacgaccggtacgggtaccgttacgaaagtacggttacgggttaccgtacggtttaacggttttacgtttaacttttacggttaaccgtaaacttaaacgttacttttaaacgtttaacccgtttacgtttaccggttaaccgggttaaccgtttcccggggttaaacccggtaaacccgggtaacggttaacgggtaaccggttaacggtaaccgtttaccggaacggtaaaccggtaacccgttaggggttactccgggttaacgaaccccgg

SEQ ID NO: 279025 - DNA, 852 bp, Homo sapiens
  misc_feature: GYAE6OF02GUT6Q.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccactattcttttancgctacgttacccaaactaatagaaaaacttacgttagctttaggtaacccaggaccaaggacgaacccgaaggtaccacgtccccttaccgtaagggccttaggaccttacgtaacgttttaccgtggggacctaacgtcccgttaacccggggaacgttccccgggggtaccccttacggaacccgttagtttccgaacggtttcgggaaccgtacgggtccgggggttaccttaggggggaacctacgggttaacgtttttcccgaacccgtttcccttaaccgaacccctaagttcccgaacggtacccgtaaccggtcccgtacgggacccgtaacgggttaccgttaaagggaaacggttacgttacggggtccgggtttaaccgtttaacggtttttttaaactttaacgtttacgggttaaacccttaaaacgttaaagttttaactttttaaacggtttaacttttaacccgtttaccggggttagggttaccccggtttaccggggaacccgttaaacgggggtaaccggtaaacggggttaggttaacgttactaaccggtaacggtaaccgttaacgtttcgggtacggaccttacccgg

SEQ ID NO: 279026 - DNA, 662 bp, Homo sapiens
  misc_feature: GYAE6OF02G2JO5.19.71.G05.1.454.CMB.1.raw
  modified_base (239)..(239): a, c, t, g, unknown or other
  misc_feature (239)..(239): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagcgggccaccatcaactgcaagtccagccacaattcttttanacagttaccaactaatacgaaaacttacgttagcttaggtaccagcagagaccaaggacagccctcgtaggctacgctactatttacgngggactacgtccgtacccgggacgtcccggggtaccctagtaccgtattcgaggtcggcgacggtcggtcgtaggactagtactttccactctaccgtacctagtacgacgtacgacgtacgtcgacctagggtcctaaggaacgtagtcggtacggtaacttaggttttaacttacgttacgtaacctaacgttaattacgtttaacgtttaactacgtttcgggttaagttacccggtttacggaacccggttaagggtaaccgtaagggttaggtaacgttaacgtacggaacggtaaccggtacgttaggtaccggtgttacgtaacccg

SEQ ID NO: 279027 - DNA, 690 bp, Homo sapiens
  misc_feature: GYAE6OF02GWQ71.19.71.G05.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (330)..(330): a, c, t, g, unknown or other
  misc_feature (330)..(330): n is a, c, g, or t
  modified_base (681)..(681): a, c, t, g, unknown or other
  misc_feature (681)..(681): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanattctttanacagttccaacaatcgaaaactacttagcttggtaccagtcaggacgtaccaggacacggacctccgtaagggctggacctctaactttacgngggactacgttcccgtaacccgggaattcccgggggtaccctagaacccgtagttccgaaggttggacctaagggccgggtcgtacggggactaggtacttttccgaacgttctaccgaacctatccgaagtacctacggtccctagaccgtacggtaccgttaggtaaacgtcgtacggttagggtaccgttaagtttttacgttaacgttacggttaactaaacgtaatttaacgttttaattaacgttaccgttacgggttacgtaacggtttacccggtaacgtaacgggtaacccgtaaggtcggtaatacggtacctaaggtaaccggtaacgttaggtacgtancggtaaccc

SEQ ID NO: 279028 - DNA, 719 bp, Homo sapiens
  misc_feature: GYAE6OF02HJV0D.19.71.G05.1.454.CMB.1.raw
tcagtactctcgtgcacgaccggtgctcgatttagtgtcgtcgcaagagagagggggagagtctgctgaattctggctgaccagggcagtcaccagagctccagaccaatgtctgtctccttcctcttcttcctgcccgtgctgggcctcccacaaggtgtcctgtcacagtacagctgcagcagtcaggtccaggactggtgaacgccctcgcacgaccctctccgactccacctgtcgccatcgtccggggacaggacgtcgacgtacgccgactaggtgttcgcttggacgtacgtggggtcacggctacgtcccccagtccggagtacggtacgtaggtacggttgggaccgtagggggaaacggtacctagtttaacgtttccgacgtttacggtaacccgaaacgttacgggttaacggtaaacttaaacgtaaaactttacgtcggacctaaccgtacgtttccgttagggtttacggaaggttacggtaccggtaacgtaacggttaaaccgtaaaacttaccgtaaaacggttaacgaaccgtaacgaacggttaaccgaaacggtaaacccttaggtttaaccctacccgtacgacgtaacgtaccgttacgtaccgttgtacgttacgacccgtaccggaggtaccggtacggttgtaacttacgtacgttaggacggtaaccggtaccggtcccctagtaccgtacg

SEQ ID NO: 279029 - DNA, 604 bp, Homo sapiens
  misc_feature: GYAE6OF02IMONG.19.71.G05.1.454.CMB.1.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagagggccaccatcaactgcaagtccagccacaatcttttanacagttccaanaatagaaaactacttagcttggtaccagcagacgaccagacagcctacctagggctggcctactatttacgtcgggctatcgtacccgggtaatcccggggtcctgaccgtattccgagtggcaggccgggtcgtgggacaggtatttccaccgttctccaccatccgagcacgccctgcgtaggctagaagagtcgtggacttatttattagtttagttacaaactaaatttattaatttaattaccgttacgttcgggttacgtttaccgggaccgtaaacggggtctaaacggggttggtaacttagtaaccgtacgaaccggtaacgttaggtcgggtaccttggtaccc

SEQ ID NO: 279030 - DNA, 597 bp, Homo sapiens
  misc_feature: GYAE6OF02JPLOK.19.71.G05.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcatccagccacatctttanacagttccaanaatgaaaactcttagctttggaccagcagagaccaggacagcctctaggctgctcatttacnggcatcgtaccgggaatccgggtcctgaccgtattcaggtggcagcgggtntgggacagtatttcactctcaaccntacgacgcacgcctgacgagcttagaacgtatggtacggtactaggttttacttagttcggtaactaaacgtaatttagttttaacttaacttaaccttacgggttacggtacccgttttcggggaacctaaaccgggggtaacctaaagggttcggtaaattaggttaaccaggtaaaccggtaaccgttagggtaccgtacgttacggaaccc

SEQ ID NO: 279031 - DNA, 642 bp, Homo sapiens
  misc_feature: GYAE6OF02ISWTO.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttaggtaccagcagagaccaggacagcctctaggctgctctatttacngggcatccgtacccgggaagtcccggggtcctacggaccgtattccgagtcggcaggtcgggtcgtgggacagtactttcactctcaaccatcagcacgcctgcgacggctagaagtagtggtacggtacttagttttattagtttacggttaactaaacttaaacttaattttaacgttttaaacgttaccgttttaacgggttcggggttaaccggtttacccgggaacccggttaaacggggtaaccgttaaacggggttaggtaaacttaacggttaacgaacggtaacggttaaccgttgggtacggtccgtacggtaaccc

SEQ ID NO: 279032 - DNA, 609 bp, Homo sapiens
  misc_feature: GYAE6OF02IIDUV.19.71.G05.1.454.CMB.1.raw
  modified_base (174)..(174): a, c, t, g, unknown or other
  misc_feature (174)..(174): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (551)..(551): a, c, t, g, unknown or other
  misc_feature (551)..(551): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacngctgcagcagtcaggtccaggactggtgaagccctgccacgaccctctccgctcacctgtcgccatccgtccggggacaggagtcgctagcgacgtagtgttgcttggctacgttgggtcagggcctacgtccccngtcgagtaggtcgtagaggtggcgtaggggaagactattattcatcgtacaacgacgtagaaatacaaattnagaccactatcgtggttagagtacgtcgtactagaactaancgtaaacgtanaccaatacgtaccggaaacggaaccttacggtttacctacccgtcgacgtactaccttccggtaaccttgttacggtacccgtaccgtccccggggaacgtaacggtaaccgggttntaacttttacggttaacgttgggtaacgggaaccgtacccggaccccagttacgaccg

SEQ ID NO: 279033 - DNA, 507 bp, Homo sapiens
  misc_feature: GYAE6OF02GGWJT.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactgggtcaggcagtccccatcgagaggtctagagtggctgggaaggacatattcatgtcaacacgtgaatacaaattatgacacatctgttgagagtcgactgacaatacaacgtagacacatacgaagaaccacgttcctcctgacagctgacctctcgtcgtacctccggacggacgacgggtgtattacgttacgtaggtacggaagacggaccccagtagtaacg

SEQ ID NO: 279034 - DNA, 706 bp, Homo sapiens
  misc_feature: GYAE6OF02F7MHA.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggagggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacatcttttanacagttccaacaatagaaaactacttagcttggtaccagcagagaccagacagcctcgtacggctgctcatttacncgggcactcgtacccgggtaattcccggggtcctaggacccgtaattccgaaggttcggacgtacgcggttacggttcgtacgggggtaactaacggtaacgttttccgtaacccttcgttaccctaaccccgtaacgtttaccgaacggtaccgtaaaccgtcccgttaggtacccgaaggggtacccttaggaaacgtagttcgggtgggtaccggttacttacgtttaaccgtcggttaacaaaccttaaagttaacgtttaacgtaggtaaaacgttccgtaacggggttaccgttttacccggcccggtttaaggggtaaccgttaaacgggttaggtaacgtacgttacgaacggtaaccgtaacgttcgggtacggtctaaccgg

SEQ ID NO: 279035 - DNA, 566 bp, Homo sapiens
  misc_feature: GYAE6OF02IKFPL.19.71.G05.1.454.CMB.1.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
tcagtactctcgtgcacgaccggtgctcgatttagtgtcgtcgcaagagagagggggagggtacaacaggcaggcaggggcagcaagatggtgttgcagacccaggtcttcatttctctgttgctctggatctctggtgcccgacggggacatcgtgatgacccagtctccagactccctggctgtgtctctgggcgagcggccacntcactgcaagtccagccatatctttacattccaanatagaaaactntagcttagaccagcagacgaccgaagactacgcctccgtaggacctgactcactttacgngggctacgtccgtaaccgggtactccggggtcctgaccgattcgagtcggcagtcggactggactagtattcnctctcacgatacgatcacgcctgccagtcgtagaangttcggngctaagtttattagttacgtacgaaacttaagttaatttacttacgttaacgtccgttaggaccggttccgacgaacgggtaacgaaggttaggaacttagtaccgaggaacccgtaagtggtacgacgtactaccg

SEQ ID NO: 279036 - DNA, 732 bp, Homo sapiens
  misc_feature: GYAE6OF02GU8SJ.19.71.G05.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaattcttttanacagttccaaacaatagaaaactacttagtcttggtaaccagcaagagaccaggaacacgccctccgtaaggctaggcctacgtattttacgtagggacctacgtaccgtaaccccggggtaacgttccccgggggttaccccttaggaacccggttaacttccggtaagggttcgggacgtacgggtccggggttacgtacggggacgtaacgttacgttttaccaccgttcctactaaccctagtccacgcctaacgtccgtcggaccgtacggtaccgttaggaaagtacgttggtacggtacttacggttttaattacgtttacgtacctaaaacgtaaatttagtttaaactttaacgttaaccgtttacggttacggggtaccgttttaccgggacccgggtaaagggtaacccggtaaagggttacggtaaacgttagtaccgaaaggtaccggtaaacgttgggttacggtccgtagtaacccg

SEQ ID NO: 279037 - DNA, 545 bp, Homo sapiens
  misc_feature: GYAE6OF02IBH0Y.19.71.G05.1.454.CMB.1.raw
  modified_base (345)..(345): a, c, t, g, unknown or other
  misc_feature (345)..(345): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccgggggacagagtcgctagcgacagtgttgcttggcactgggtcaggcagtccccatcgagaggtctagagtggctgggaaggacagttattcatgtcaaacncggtagaatacaaattatgacacatctgttgagtagtcgactgacaattacaacgtagaacacgtatacgaaacgaaccgtacgttcctaccctggaccagtctcgtaccttcgtagtcgacctcccggtaaggaccgacgggttctaacgttagtttacgtaggtacgggaacggacccggaccccgtagtacgtaacg

SEQ ID NO: 279038 - DNA, 553 bp, Homo sapiens
  misc_feature: GYAE6OF02JDDOJ.19.71.G05.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
tcagtactctcgtgcacgaccggtgctcgatttagtgtcgtcgcaagagagagggggaggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccaccatcaactgcaagtcccagccacaatcttttanacagttccaacaatgaaaactacttagcttggtaccagcagagaccaggacagcctcctagctagctcatttaccngggcagtctacccggaatcccggggtcctacgaccgattccgagtggcaggcggtctggacagatttcactctacactatcagcacgcctgcaggctgaagnttaggngacgtagttaattnttagtacaactaacttaattattaacttcttgtaggtaccttacgggacgttaacgggaaccgtaacggtagtatacgttacgtaacgacggttaacgtggtaacggtctagtacccg

SEQ ID NO: 279039 - DNA, 539 bp, Homo sapiens
  misc_feature: GYAE6OF02GLAP1.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactgggcatcctacccgggaatccggggtcctgaccgattcagtgcagcggtctggacagtatttcactctcacatcagcagcctgcagctgaagatgtgctagtttatattgtactaactaattattaattatacgttgtacggtacgttcggaccgtaacgggtacctaagggtacggaattacgttacgaacggtacggtaaacgttcggtaggtccgtagtacccg

SEQ ID NO: 279040 - DNA, 852 bp, Homo sapiens
  misc_feature: GYAE6OF02ICLPS.19.71.G05.1.454.CMB.1.raw
  modified_base (245)..(245): a, c, t, g, unknown or other
  misc_feature (245)..(245): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccgacggggacatcgtgatgacccagtctccagactccctggctgtgtctcgtgggcgagcgggccaccatcaactcgcaacgtccagccactaattcttttanactacgttacccaaactaatacgaaaaacttacttacgtctttacggtacccagaccaggaacgacccgaaggaccacggtcccttaccgtaggctgcctactaacgttttacgtcgggacctacgttaccgtaaccccggggaacgttcccgggggtacccctacggaacccgttattccgagggttcggacgacggggtccggggttacgtacgggggaacctacggttactttttacccgaaccttccgtaccctaaccgtatccgaacgccgtaacgtcccgtaggaccgtacggtccgttaaggtaaacggtagttacgggttcgggttacgtttaaacgtttttacgtttaacgttttaccggttaacctaaaaccgttaaagtttttaacgttttaactttttaacgtttaaccggtttttaccgggttaccggggtttaacccgggttttccccggggtaaacccggggttaaaccgggggttaaaccccggttaaaggggggtttacggttaaacgttttaaccgggtaacggttaaacgggttaaacccgggttaaggtttaccggggtacgggtttacccgtaccggttaaccccg

SEQ ID NO: 279041 - DNA, 594 bp, Homo sapiens
  misc_feature: GYAE6OF02F3C2B.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttanacagttccaacaatgaaaactacttagcttaggtaccagtcagtagaccaggacagcctctaggctcgctcatttacgngggctactcctaccgggatcccggggtcctcgaccgtattccgagtcggcacggcggtcgagggacagtactttcactctcgaccatccagcacgcctgacacggctagaagtgtcggtgacgttagtttatagttacgtacaaactaattatttaactttacgtaacgtttcgtacggttaccggttaccggaccgtaaagggtacccgttaaggggtcggtaactaacgtaccgtaacggacggtaaaccgttggtacggtccgtagtaacccg

SEQ ID NO: 279042 - DNA, 564 bp, Homo sapiens
  misc_feature: GYAE6OF02JIKU2.19.71.G05.1.454.CMB.1.raw
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctctgggcgagcgggccaccatcaactgcaagtccagccacaatctttanacacgttccaacatgaaaactcttagcttgaccagcaagataccaggacagcctctagctgcctnatttacgnggaccatcgtacccggaattcccgggtcctgacctatcaaggtggcaggtcggtctgggacagtacttttcgaacttcgtcaccgatacgacgtacaggccctaggccgtacggactagtaaagtcgttcggaggttacctagttttaatagtttaggaacctaaacgtattaacgtttattactacgttcgtagtccgttcgacaacgggtcgaaagtcgagttatagacgtaacgacgttgacggtactcgacg

SEQ ID NO: 279043 - DNA, 519 bp, Homo sapiens
  misc_feature: GYAE6OF02IC719.19.71.G05.1.454.CMB.1.raw
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcaganaccaggacagcctctacggctgctcattacngggcatctacccggacgtccgggtccctgaccgattcagtggcagcgggtcgnggacagattttcactctcacccgtatcagtccagccctgccgtaggcttagacgtanggtagtctagtttattatgtacaactatattattactagtcgtgtacgtcggtacgaggtaccggagtagtatctagacgacgtaatggtgcgtgacc

SEQ ID NO: 279044 - DNA, 519 bp, Homo sapiens
  misc_feature: GYAE6OF02HB82H.19.71.G05.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (435)..(435): a, c, t, g, unknown or other
  misc_feature (435)..(435): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggtaccagcagagaccaggacagccctcctaggctgctctatttacgngggcataccgtacccgggaatcccggggtccctggaccgtattcgagtcggcaggcgggtgtcgggacagtactttcactcctcacctatccagcacgtcctgcaggctagaacgtntgtgctagtttattgtatacaataatattattatacttgtagtacgttcgactaaggtcaggtgatagnagacagtgngtcngc

SEQ ID NO: 279045 - DNA, 657 bp, Homo sapiens
  misc_feature: GYAE6OF02GBLBC.19.71.G05.1.454.CMB.1.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttanacagttccaaactaatagaaaactacttagcctttaggtaaccagcagagaccaggacagcctcgtaggctgctcatttacgnggcactctacccgaggtaacgtcccgggtcctgaccgattcgagtcggcaggcggtcgtagggacagtactttacacttcctcacctatctagccgtaacgcccttagccgtaaggtcttacggaaagtacgtggtccggttacgttaaggtttttaacttagtttacgtaacgtaaaccttaaagtttaacttaacgtttaacttaaccgtttcggttacgggttaaccggttttcccgggaaccggtaaacgggttaaccggtaaagggtcggtaacgttagttaaccggacggtaaccggtaaccgttacggggttacgacggttacccgg

SEQ ID NO: 279046 - DNA, 571 bp, Homo sapiens
  misc_feature: GYAE6OF02F64WH.19.71.G05.1.454.CMB.1.raw
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
  modified_base (360)..(360): a, c, t, g, unknown or other
  misc_feature (360)..(360): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccactaattcttttaanacagttaccaaacaatagaaaactcttagcttaggtaccagcagacgaccaggacacgcctcctaggctgctctattacgnggctatccgaccgggacgtccggggtcctgacctnttcgagtcggcaggcgggtacgtgggacagtactttcactcncacntcagcacgcctgcgaggctagaagtgtggtggtattagtttattattacgtactaaactaattaatttaattacttacgttcgtacggtacgttcggaccgtaacgggtaacgtaagggtagtacttagtacgaacggtacgtaagttcggacggtaccgtgacc

SEQ ID NO: 279047 - DNA, 536 bp, Homo sapiens
  misc_feature: GYAE6OF02GLFBO.19.71.G05.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattcttttanacagttccaacaatagaaaaactacttagcttaggtaccagcagacgaccaggacagcctcctaggctgctcattacnggcatctacccggaatccggggtcctgacgattcagtggcagcggtctgggacagtatttcactctacacatcagcagtcctgcaggctagaagagtggtgtctaggtttattattagtactaaacgtaattattattatacttcgtagtacgttcgaccgtaacgggtacctaagggtgtaatactcgaacggacgaacgttggtaggtcctaggtaccc

SEQ ID NO: 279048 - DNA, 536 bp, Homo sapiens
  misc_feature: GYAE6OF02IGU8R.19.71.G05.1.454.CMB.1.raw
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
  modified_base (370)..(370): a, c, t, g, unknown or other
  misc_feature (370)..(370): n is a, c, g, or t
  modified_base (437)..(437): a, c, t, g, unknown or other
  misc_feature (437)..(437): n is a, c, g, or t
tcagtactctcgtgcacgaccggtgctcgatttagtgtcgtcgcaagagagagggggaggtacaacaggcaggcaggggcagcaagatggtgttgcagacccaggtcttcattttctctgttgctctggatctctggtgcccacggggacatcgtgatgacccagtctccagactccctggctgtgtctcgtgggcgagccgggccaccatcaactgcagtccagcccacaattcttttanacagttaccaacaatagaaaactacttagcttggtaaccagcaagacgaccaaggaccagccctccgtaggctgcctcattttacgnggcactccgtaacccgggtaagtcccggggtcctcgaccgtnttcgagtggcaggtcggtctgggacagtatttccactctcacatcagcacgctgcaggctagaacgngtgtgctagtttattatgtacaatattattattatcttgtgtacgttcgacgaggaccgtaaggtcgaatacacgagtacgtaatggtacgtctgtacc

SEQ ID NO: 279049 - DNA, 724 bp, Homo sapiens
  misc_feature: GYAE6OF02IU9I7.19.71.G05.1.454.CMB.1.raw
  modified_base (239)..(239): a, c, t, g, unknown or other
  misc_feature (239)..(239): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcagtccagccacaattcttttanactagttaccaacaatagaaaacttacttagtcttaggtaccagcaagacgaccaggacacgcctccgtaggctacgctactactttacgngggcactaccgtacccgggaacgtcccggggtaccctcggaaccgtattacgaggttcggacgacggtccgggttacgtcggggaactaggttacttttaccgacttcctacgaccctaagttaccacggccctaacggtcccgttacgaccgacggtccgttaaggtaaacgtagttcgggtacggtactttaacggtttttaagttagtttacgttaacctaaaactttaaagtttaacttttaaacgttttaaccttaacggtttttaccgggtacggtttaacccgggtttaccgggaaccggttaaacggggaacccggttaagggttacggtaattaacgttacggtaacgggtaaccgtaacggttcgggtacgtccgtagtacccg

SEQ ID NO: 279050 - DNA, 580 bp, Homo sapiens
  misc_feature: GYAE6OF02GZQ66.19.71.G05.1.454.CMB.1.raw
  modified_base (238)..(238): a, c, t, g, unknown or other
  misc_feature (238)..(238): n is a, c, g, or t
  modified_base (425)..(425): a, c, t, g, unknown or other
  misc_feature (425)..(425): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctccagctgcctcatttactgggcataccgtacccgggaactccggggtccctgaccgtattcagtggcaggcgggtcgtgggacagtactttcgactctccaccatccagacacgcctgcaggctgaagntgtagtactagtttattagttagtacaaactaagttattaatttaattactttacgttacggaccgttttccggaccgtaacgggtaccgtaaagggtacggtaagttaacgttacgaacgtaacggtaaccgttagggtacggtacgtgtaccc

SEQ ID NO: 279051 - DNA, 807 bp, Homo sapiens
  misc_feature: GYAE6OF02ICDMG.19.71.G05.1.454.CMB.1.raw
  modified_base (269)..(269): a, c, t, g, unknown or other
  misc_feature (269)..(269): n is a, c, g, or t
  modified_base (665)..(665): a, c, t, g, unknown or other
  misc_feature (665)..(665): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggactctctggtcgaccctaggggacatcgtgatgaccctagtctaccagacctcccgtggctgtcgtctcgtcgggcgtaggccggtccactacgtcaacgttgacctaacgtccgacgacctaactaatttccgttttaanacctaacggtttacccaaaataacgtacgtaaaaaccttacgttacggtacgtttacggtaaccagtaccgaacgtacgtaaccgtaggtacctaccggtacctaccggtaaggccttcggtaccttacgtaacgtttttaccggcgggtaccttaacggttacccggtaaccgggtaacgttccccggggtaaccttcggtaaccgttacgttcgtaacggtggtacgacgggttcgggtactagggacctaggttactttaccgacgtacgtacgaaccgtacgtcgaacgtcgaaccggttccgtaacgtccgaaaggtttcccgaagggtttaacacggttacggttcgtaacgtttaagttttacgttaacggttaccgtacaaaacgttnttaacgtttaccgttacgttaacggttccggttaacggtaccgtttaccgggaacgttaacgggtacccgttaagggttacgaagtttaccgaacggttaacgtaccggttaacggttcggtacgtaccgtaggtaaccccg

SEQ ID NO: 279052 - DNA, 769 bp, Homo sapiens
  misc_feature: GYAE6OF02ILAH5.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactcccgtggctgtgtctcgtgggcgagcggccaccatcaactgacaacgtccagccactaattcttttaacactacgttaccaactaaactacgtaaaacttacttagcttaggtaccagacgagacgaccgaggacacgcctccgtaggctgctactactttacgcgggtacacgttaccgtaacccgggaacgttcccggggtaccctacggtaacccgtagttaccgaggttcggacgtaggtccgggttcgtagggacgtacgtacttttcccaacttccgactaaccctagtaccgacgcgtaccggcttacgacgtaacggtccgtaaggaaacgtaggttacggtacgggtaccgttaaagttttttacgttaacttttaacggtaaaccttaaaaacgttaaacgttttaactttaaagtttttaaccttaaccgggtttttaccgggtttaaccggggttaaccgggtttttaaacccggggtaaccggtaaaaaccgggggttaaccggttaaacggggttttaacggtaacgtttaaacgttacgggtaaaacggttaccgggtaaacgtttaccgggg

SEQ ID NO: 279053 - DNA, 660 bp, Homo sapiens
  misc_feature: GYAE6OF02H8C5N.19.71.G05.1.454.CMB.1.raw
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccaactaattcttttanacagttccaacaatagaaaactattagcttggtaccagcagagaccaggacagcctcctatgctgctctattacgnggacatccgtaaccgggtagtcccgggtcctgaccgtattcgagtcggcgacggtcggtcgtcgggaacgtagtacgttttcacttcctactaaccatccgacgtacgacgtcctggacgacggtctaaggaacggtagttcggtcggtacgttaaggtttagtttaacgttacgtaaccgttaaacgtaatttaactttaaagttactttaaccgtttcggttacgggtacccggtttaccgggaaccggtaaaccggggtaacccgtaaaggggttaaccggttaagtaacggttacggaaacggtaaccggtaacggttacgggttacggcgtaaccgg

SEQ ID NO: 279054 - DNA, 541 bp, Homo sapiens
  misc_feature: GYAE6OF02IKRJW.19.71.G05.1.454.CMB.1.raw
  modified_base (234)..(234): a, c, t, g, unknown or other
  misc_feature (234)..(234): n is a, c, g, or t
  modified_base (324)..(324): a, c, t, g, unknown or other
  misc_feature (324)..(324): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttatacagttaccaacaatagaaaactacttagcttaggtaccagcagagaccaggacagcctcctaggctgctctatttacgngggacagtaccgtaacccgggaatcccggggtccctgacctattcagtgcaggcggtctgggacagtatttcactctccacatcagcacgtcctagcgacggctagaatagtgtggtactagttttattatgtaacaataattaattattactacttcgtaggtaccgttcgaccgtaaggaccgtaagggtgaattacgtacacggtacgagtcgg

SEQ ID NO: 279055 - DNA, 683 bp, Homo sapiens
  misc_feature: GYAE6OF02ISLV1.19.71.G05.1.454.CMB.1.raw
  modified_base (241)..(241): a, c, t, g, unknown or other
  misc_feature (241)..(241): n is a, c, g, or t
  modified_base (333)..(333): a, c, t, g, unknown or other
  misc_feature (333)..(333): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccacggggacatcgtgatcgacccagtctccagacctccctggctgtgtctctgggcgagcgggccaccatcaactgacaagtccagccacaattctttanacacgttaccaaactaatagaaaacctacttagcttggtaaccagacagagaccaaggacacgcctaccgtaggctcgctactactttacgngggactagtacccgtaaccggggaacgttcccgggggtaccctacgggaacccgtacttacgaggtcggacgtacgggtccggggtcgtacggggaactacggttaactttccgaactacctccaacctacgtcaacgtccaacgtccctagccgaaggtctaaggtaacgagttacggtaggtactttaagtttattaagttacgtaacctaaagttaatttaagtttaactttaaacttaccgtttaggtacgggttaaccggtttacggaaccggtaacgggtaaccgtagggtacggtaatacgtacgaacggtaacggtaacgttggtacggtacgtacgaaccg

SEQ ID NO: 279056 - DNA, 628 bp, Homo sapiens
  misc_feature: GYAE6OF02IGU45.19.71.G05.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccaanatctttaacagttccaanaatagaaaactacttagcttggtaccagcagagaccaggacacgcctctaggctgctcatttcgnggcagtaccgtacccgggtatcccggggtcctgaccgtattcgagtcggctaggcgggtctggggacaggtacttttccgacttctacgacctatcagcacgcctagccgaggtcctaggaacgatcggtacggtactaagtttaacttaccgtaggtacctaagtcttaacttttactttttccgttaacgttcccgttaccggttacggtacccggttttaccgggacccgtaaacggggtacccgtaaggggtaacggtaaacgtccggtaacggtaaccgtaaccggttgggtaccggtacgttacggaacccg

SEQ ID NO: 279057 - DNA, 632 bp, Homo sapiens
  misc_feature: GYAE6OF02H18VN.19.71.G05.1.454.CMB.1.raw
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
  modified_base (626)..(626): a, c, t, g, unknown or other
  misc_feature (626)..(626): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgcaagtccagccacaattctttanacattaccaanaatagaaaactacttagactcgtaccagcagagaccagacacncctacgtagctgactcaatttanggcacgtaccgaccggtactccgggtcctacgaccgtntcgagtaggcgtaggcggtcagggacctagtactttacactctacacctatcaagtcacgtccgtagccaacggcttaaggaaagcgttacgggtacggtacctttagggtttaatttacgttaacgtacctaaaattaaacgtttaagtttaacttttaaacgtttacgttacggttacgggtaacggtttaccgggtaaccggaacggggttaacgaaacgggttgtaaacgttagtacgtaaggtaccgtaacgtagtcggtacctntaaccg

SEQ ID NO: 279058 - DNA, 818 bp, Homo sapiens
  misc_feature: GYAE6OF02GOPMO.19.71.G05.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctactggtgccgacggggacatcgtgatcgacccagtctccagactccctggtctgtgtctcgtgggcgaggcggaccaccatcaactgacacgtaccagccactaattccgttttanaccgtacgttaccaaactaagtacgtaaaaaccttcgttaacggtaccttacgggtacctaaggtccaaggaaccgtaaccggaacggaccgtacgtcccgttaccggtagggtcccttaggacccttccgtaaacgttttaccggtacgggtaccttaacggttcccggtaaacccggggtacggttccccggggtaccgttacggaaacccggttagttaccgtacgggtacggtaccgtacgggtccgggtacgttacggggtaacctacggttaaccgttttcccgacgtttacccggtactaacccgttaccgtaccgaaccggttaccgacggttcccgtacggtacccgtaacggggtccctttaaagggacgttacgtttcgggacggtttaacctttaacggttttaacttacgttacgaaaaccgttaaaccgttattaaaccgttttagttaacccgtttcgttaaccggttacgggtaccggtttaacccggaacggttaaccggtaacgttaggttcggaacttcggaccgtaacggccgttaacgtggg

SEQ ID NO: 279059 - DNA, 398 bp, Homo sapiens
  misc_feature: GYAE6OF02JFHA6.19.71.G05.1.454.CMB.1.raw
  modified_base (356)..(398): a, c, t, g, unknown or other
  misc_feature (356)..(398): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccgacggggacatcgtgatcgacccagtctccagacctccctggctgtgtctcgtgggcgagcggccacatcaactgcaagtcacgccactaacttcttttaacactacgttaccaaacaataacgtaaaacttaattaaccccccccccccccgtagttacggtaaccgaacgacgaagaacgaacccgaagaccgaacgcctaccgtacggtnnnnnnnnnnnnnnnnnnnnnnnnnnnnnnnnnnnnnnnnnnn

SEQ ID NO: 279060 - DNA, 531 bp, Homo sapiens
  misc_feature: GYAE6OF02IXZYZ.19.71.G05.1.454.CMB.1.raw
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
  modified_base (508)..(510): a, c, t, g, unknown or other
  misc_feature (508)..(510): n is a, c, g, or t
  modified_base (512)..(531): a, c, t, g, unknown or other
  misc_feature (512)..(531): n is a, c, g, or t
tcagtactctcgtgcacgaccggtgctcgatttagtgtcgtcgcaagagagaggtctagagtggctggggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagcggcccccatagacatgccacctcgtctctggtgctatagtggggccagggaacccatgtcaccgtcctccctcggccctcccgaaccgaagggcccctatccggttccttccccccgtggccgcccctcgcctccaggacgccacccgtccggagacgacacgacggccgggcccctggggcctcggcccgtgggtaccaaacgggtacctacccttccccgaacggtaggaacgttacgnggacggccggggctcggggaccaacgggcgacctagtacgncnnngnnnnnnnnnnnnnnnnnnnn

SEQ ID NO: 279061 - DNA, 626 bp, Homo sapiens
  misc_feature: GYAE6OF02FVABX.19.71.G05.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtcccagccacaatcttttanacagttccaacaatgaaaactacttagcttggtaccagcagagaccaggacagcctcctaggctgctcatttacngggcatccgtacccgggaatcccggggtccctgaccgtattcagtggcaggccggtngggactagatttcgacttctccactatcgancgacgcctgccgaggcttaggaagtagtcggtaggtctaagtttttattagttagtacctaaacttaaagttaattttaacgtttaattaccggtttcgttacggttaaccggtttaccgggacccgtaaaggggggtaaccctaaggggtttacggtaacgtttaacgtacccggtaaggtaaccggtaaaccggttggtacgggtaccgttcggtaaccccg

SEQ ID NO: 279062 - DNA, 629 bp, Homo sapiens
  misc_feature: GYAE6OF02FTZLO.19.71.G05.1.454.CMB.1.raw
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanactagttccaacaatagaaaactacttagcttggtaccagcagacgaccaggacacgcctcctaggctgctctatttacgnggcatccgtaacccgggacgttcccgggggtccctggaccgtattcgaggtcggcgaggcggggttctgggacctaggtatttcacgtcctacacctatcagcacgccgtggaccaggctaggaacgtagttcggtcgtacgttagttttatttacgttacgtaactaacttaaatttaatttaagtttaacttaccgttttacgggttacggttaccggttacgggaaccggtaacggggtaacccgtaagggttacggtaattacgacgtaacgtacggtaacgttcgggtacggcgttacgacccg

SEQ ID NO: 279063 - DNA, 628 bp, Homo sapiens
  misc_feature: GYAE6OF02I9EUL.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactcttagcttggtaccagcagagaccaggacagcctcgtaggctgctctatttacgnggactagtcgtaacccgggaagtcccggggtccctgaccgtattcgagtcggctaggtcgggtcgtagggacaggtactttaccactcctaccacataccacgccacgtcctgacgaggcgtaggacgtacgtggtcgtaccgttaagttttacgttaacgtttacggtactaaacttaatttaactttaagtttaacgttacgtttaccgggtacggttaccggttaccggaacgtaaacggggtaccctaaagggtacggtaattacgtacgaacggtaaccgtaagttacggtacggtcgtacgtacccg

SEQ ID NO: 279064 - DNA, 608 bp, Homo sapiens
  misc_feature: GYAE6OF02F6ZDX.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtgggtcacggcacgtccccatcgagaggtctaggagtgcgtgggaagactattacttcagtgtaccaacgacgtaggaaataacaaattatgacacatctgttagagtacgtcgactgaactaataccgtaaacgtacgacaactacgtacgaaacgtaacctacgttaccctaccgtacgacgtacgtccgtagtacccttcgttacggtaccgtacccgtacccgggaacgggtaaccggtacgggtttaacgttaacgtttaacgtttaacggttaggtacgggtaaaccggtacccggtacccccgtaagttaaccgaaccg

SEQ ID NO: 279065 - DNA, 731 bp, Homo sapiens
  misc_feature: GYAE6OF02G85DR.19.71.G05.1.454.CMB.1.raw
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
tcagtactctcgtgcacgaccggtgctcgatttagtgtcgtcgcaagagagaggggggaggtacaacaggcaggcaggggcagcaagatggtgttacagacccaggtcttcatttctctgttgctctggatctctggtgcccgacggggacatcgtgatcgacccagtcctccacgtactcccgtggctgtcgtctcgtgggcgacggccggccacatacaactacaacgtccacgaccaactaacttcttttanactacgttaccaactaatagtaaaaccttacttagcttacggtaccagacagacgaccgagacacgcctacgtaggctcgctactagtttacgnggactacgtccgtaccgggacgtcccgggtcngacctntcgagtgacgaggtcggtgtagggactacgtacttccgacctaccgtacaacctacgtaccgtacgacctacggtcccgtacggtaccgtaacggtaccgtaaggtaaccggttaggttcggttacggttacctttaagtttttaacgtttacggtttaacgtaaacttaaaccttaagttttaaacgtttaactttaacgtttaccggttttaccgggttacggttaacccggttaaccgggaaccggttaacggggaaccgttaagggtcgttaaacgtaacgtaccggtaacggtaaccgtaacggttcggtaccggttacgtaccgtacgtaccgttacg

SEQ ID NO: 279066 - DNA, 610 bp, Homo sapiens
  misc_feature: GYAE6OF02I8AKN.19.71.G05.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgctaagtccagccacaattctttanacagttaccaanaatagaaaactacttagcttggtaccagcaagacaccaggacagcctctaggctgctcattacgnggcatcgaccggatccgggtcctgaccattcagtgcgagcggtgtggacacggtactttccacgttcctaccgaacctatacgacgtaccgacgtcgtacgcgaacggtcttaaggaatagtggttgactttaaggttttaattagttaacgttaccaaaagttaatttattaactttaacgtactttcgggacggttaccgttacggaccgtaacggggtaccgtaagggttcggtaaacttacgtaacggtaacggtaaccgttaaggtaccggtggtaccttacggtacccg

SEQ ID NO: 279067 - DNA, 525 bp, Homo sapiens
  misc_feature: GYAE6OF02HOJO8.19.71.G05.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagtactctcgtgcacgaccggtgctcgatttagtgtcgtcgcaagagagaggggggaggtacaacaggcaggcaggggcagcaagatggtgttgcagaaccaggtcttcatttctctgttgctctggatctctggtgcccacggggacatcgtgatgacccagtctccagacctccctggctgtgtctctgggcgagcgggccaccatcaactgcaagtccagccaacaatcttttanacagttccaacaatacgaaaactacttagcttggtaccagcagagaccaggacagcctcgtaggctgctcatttacnggcatccgtaccgggaactcccggggtcctgaccgtattcgagtcggcaggtcgggtctgggacagtatttcactctcacatcagcagcctgcaggcagagatgngctagtttntattagtacaactatatttattatacttgtacgacgttcggactaagggtaccaaggtcgaattacgtacgagacgaactggtacggctgaccg

SEQ ID NO: 279068 - DNA, 611 bp, Homo sapiens
  misc_feature: GYAE6OF02HAM5J.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattcttttaanacagttaccaacaatagaaaactacttagcttggtaccagcagacgaccaggacagcctcaggctgctctaatttacgngggacataccgtacccggggaacttcccggggtccctaggacccgtattcgaggtcggcgaggcgggtcgtgggacagtatttcactctaccaccatcagccagcctgcctaggctaggaagtcgtggtagtactagttttatagttcgtactaacttaagttatttaattaacttacgttacggtaggtaaccggttaccggaaccgtaaacggggtacccgtaagggttacggtaacttacgttaccgaaggtaacccgttaacgttacgggtacggtacgtacggtaccc

SEQ ID NO: 279069 - DNA, 538 bp, Homo sapiens
  misc_feature: GYAE6OF02F5OGZ.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (366)..(366): a, c, t, g, unknown or other
  misc_feature (366)..(366): n is a, c, g, or t
  modified_base (504)..(504): a, c, t, g, unknown or other
  misc_feature (504)..(504): n is a, c, g, or t
  modified_base (532)..(532): a, c, t, g, unknown or other
  misc_feature (532)..(532): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacngggcatcgtacccgggaatccggggtccctgaccattcagtggcagcgggtcgngggacagactttcactctcgaccatcagtcacgccgtgcgaggcctagaacgatggtaggacctagttattagttagtacaaacgtaatatttaattaatacttggtcgtacgttaggaccgaaggcctaagggtagntaagtcagaccgaacgtgtcggtacgtntacccg

SEQ ID NO: 279070 - DNA, 562 bp, Homo sapiens
  misc_feature: GYAE6OF02GMZV4.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctccgtaggctgctcatttacngggctatccgtacccgggaatcccggggtccctagaccgtattcgagtggcgaggcgggtcgtagggacagtactttcgactctacaccatcacgcacgtcctgcgagctaggaagtagtgtcggtactagtttattatcgtacaaactaagttattattaactacgttcgtacgtacgttcggaccgtaacgggtacgtaaggttagaacttatacgaacgtacgtacgtacggtgtacgtgtacc

SEQ ID NO: 279071 - DNA, 762 bp, Homo sapiens
  misc_feature: GYAE6OF02HLXO2.19.71.G05.1.454.CMB.1.raw
  modified_base (245)..(245): a, c, t, g, unknown or other
  misc_feature (245)..(245): n is a, c, g, or t
  modified_base (350)..(350): a, c, t, g, unknown or other
  misc_feature (350)..(350): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctcgtggtgcccacggggacatcgtgatgacccagtctccagactccctggctgtgtctctgggcgagcgggccacgatacgaactgacaacgtcagccaacaattcttttanacagttaccaaacaagtagaaaaactacgttagtacttaggtaaccaggacaagacgaaccgaggacacggacctacgaaggcctgacctacgttaatttaccgngggacctaacgttacccggtaacccgggaacgttcccgggggtacccttacggaacccggttaagttccgaaggttcgggacgtaacgggttccggggttacgtacggggacctaaggtaacttttcccgaacgtttaccacgtaaacctacgttacgaacggtacgtacgacccggtacgaacgtaaggccttaaggaaacgtaagcgttacgggacgtttaagtttttaaacgttagtttacggtaaaccctaaaactaaagttttaactttaaactttaacggttaccttaccgggtaacggttaccggttaccggaacccttaaagggggaaccttaacggggtagaacgtttaacgacggtaaacggaacccgtaaacggttacggtacggtaccggtcggtaaccc

SEQ ID NO: 279072 - DNA, 728 bp, Homo sapiens
  misc_feature: GYAE6OF02H3DBE.19.71.G05.1.454.CMB.1.raw
  modified_base (354)..(354): a, c, t, g, unknown or other
  misc_feature (354)..(354): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccaccatcaactgcaagtccagccactattctttatacagttaccaaactaatagtaaaaaccttacgttagtacttaggtaaccaaggacaacgaagtaacccgaaggaccagtcccttccgtaggcctgcttacctagttttacgngggactacgttacccgtaacccggggacgttccccgggggttccctaggtacccgtaattccgaggtcggacgacggtcgggtacgtcgggactaggtacctttcgaaccttcgtacccaacgtactacacgtacacgtccctgccgtaaggccgtaaggtaagtagtcggtacgtctaaggtttactttacgttacgtaacctaaactaagttaacttttaacgttaacgtttacgttcggttaccgggtttaaccgttaccggggtaacccgttaacggggaaccggttaaacggggtacggttaaaggtacccgtttaagaaccggttaacggtaaccgggttacggtaccgggttcgtacgtaaccccgg

SEQ ID NO: 279073 - DNA, 683 bp, Homo sapiens
  misc_feature: GYAE6OF02IW3GF.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagacctccctggctgtgtctcgtgggcgagccggccaccatcaactgacaacgtccagccactaacttcttttatactagttacccaactaatagaaaacttacttagccgtttaggtaccagacagagaccaggacagcctaccgtaggctgctctattacgtggctacgtaccgtacccgggaacgtccccggggtaccctaggacccgtacttcgacggtcggccgtaggccggggtacgtcgggacagtactttaccaccgttcctaccgaacctactaccgaacgccgaccgtcccgtacggacgtacggacctagggaacgtaggttcggtgggtacctttaggttttaatttacgtttacgtaacctaaactaacttaattttaatttaacgttacgtttacggtagggttacccggtttaccgggaaccgtaaaccgggggtaacgttaaggggttacggtaagtaccgttaaccgaacggtaacccgtacgttacggg

SEQ ID NO: 279074 - DNA, 510 bp, Homo sapiens
  misc_feature: GYAE6OF02I8ZGI.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactgggtcaggcagtccccatcgagaggtctagagtggctagggagacagttattcgatgtaccaacgacgtgaatacaaattatcgctaccattctgttgagagtcgactgacaatcgaacgtagacacatcgaacgtacagtctacctgcacgtctcgacctgtgtcgactcccgaggacgtaccggtgtactgttacgtggtacggaacgtacggacccctagtacgtaac

SEQ ID NO: 279075 - DNA, 582 bp, Homo sapiens
  misc_feature: GYAE6OF02JFMRP.19.71.G05.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (317)..(317): a, c, t, g, unknown or other
  misc_feature (317)..(317): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcggccaccatcgaactgcaagtccagccanaatcttttanacagttccaanaatagaaactactagcttggtaccagcagagaccaggacagcctccgtaggctgctctatttacgnggcatacgtacccgggatcccgggtcctgaccgtattcagtggacaggccgggtntgggactagtactttcacgtcctcgaccatcagcacgcctgcgaggctagaagtgttggngtactaagttttatattacgtacaaacttaagttaatttatttaacttacgttcgtacggtaacgttccggaacgtaacgggtaacccgtaaggtaggtaattacgttacgaacggtaaccggtacgttaggtacgtcgttacgaacccg

SEQ ID NO: 279076 - DNA, 669 bp, Homo sapiens
  misc_feature: GYAE6OF02ICV3V.19.71.G05.1.454.CMB.1.raw
  modified_base (175)..(175): a, c, t, g, unknown or other
  misc_feature (175)..(175): n is a, c, g, or t
  modified_base (442)..(442): a, c, t, g, unknown or other
  misc_feature (442)..(442): n is a, c, g, or t
  modified_base (497)..(497): a, c, t, g, unknown or other
  misc_feature (497)..(497): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacngctgcagcagtcaggtccaggactggtagaacgccctcgcacgtacccctctccgctcacccttggtcgcctactccgtacccgggggactaggacgtcgactacggccgacgtaggttgttggcctttgggctacgttgggtccgaggccaccgtccccagtaccggaggacggttaccgtaggacggtgggacggttaggggaaacggtactagttacgttcgagttcgtaccgaaacgtcggtaaggtaaactaactaaattancgtactactattcgtgttagagtcgtacgacttacgaactaatacgtaaacgtanaacaactacgtacgaaacgtacctacgttccctacccgtagccgtacgtcgttcgaccttcgtacggtaccgtacccgtaaccggtacggtaaccggtaacgggttacgtaactttaacgttacgtacgggttaacgggtaccggaaccccggtaccctagtaccgtaaccg

SEQ ID NO: 279077 - DNA, 578 bp, Homo sapiens
  misc_feature: GYAE6OF02F2VIT.19.71.G05.1.454.CMB.1.raw
  modified_base (254)..(254): a, c, t, g, unknown or other
  misc_feature (254)..(254): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgccagacccctctcgctcacctgtcgccatctccggggacngagtcgctagcgacagtgtgcttggcacgtggtcaggtcacgtcccagtcgacgaggttacctagacgtggcgtggggaaggactagttactttacgatcgttaccaacgacgtaggaaactaactaaattcagcacctatctgttagagtagtacgactgacaataccgtaaacgtagaacacgactacgaaacgtaacctagttacccttaccgtgaccgaagtctacgtacctcgttcgtacaccgtacccggaggaccggtaacggttagttaactacgttaacgtggtacgggaacggaccggaccccgtatacgaacg

SEQ ID NO: 279078 - DNA, 580 bp, Homo sapiens
  misc_feature: GYAE6OF02IN23Z.19.71.G05.1.454.CMB.1.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaccagcagagaccaggacagcctctaggctgctcattacnggcatcgtaccgggaatccggggtcctgaccgtattcagtggcaggcgggtctgggacagtactttcactctccaccatcgagcacgccgtgcaggctaggaagacgtgtggacttagtttattagttagtactaaactaattaatttaattaacttacgtttcggtaacggtacggttaccggaaccggtaacggggaacccggtaagggtacgggtaattaacgtacgtaaggtacgtaaacggtcggtaagggcctaggacccg

SEQ ID NO: 279079 - DNA, 581 bp, Homo sapiens
  misc_feature: GYAE6OF02J1WA0.19.71.G05.1.454.CMB.1.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattcttttanactagttaccaacaatagaaaactacttagcttaggtaccagcagacgacaggacacgcctctaggctgctcatttacgnggacatccgtaccgggacttcccggggtcctgaccgtattcgagtcggcgacggtcggtcgtgggaactacggtattttcacttctccgaacctataccacgccacgccgtcgtcgacggctagaagatcgtgtactagtttattagttgtacaactaagttacttagttattactcggtagtacgtaccggacgtaacgggtaacgtaggtacgtaagttacgtacgaacgtacggaacgttgtacggtcgtacgtaccg

SEQ ID NO: 279080 - DNA, 690 bp, Homo sapiens
  misc_feature: GYAE6OF02GZ80R.19.71.G05.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtcctccagactccctggctgtgtctcgtgggcgagccgggccaccatcaactgacaacgtccagaccactaacttcttttanaccacgttaccaaactaatacgaaaacttacttagacttacggaccagcaagacgaccaggacagtccctcgaggtcngtctactagtttcgnggactactccgtaacccgggagttcccggggtcctacgaccgtattcgaggtcgacgtaggcgggttacgagggacctagtactttccacttccactacctatccgacaccgtagtcccgtcgacggacggtcgtaaggaagtagttacgggtacgtaacttttaaggtttaactttacggttaaccgttaacgaaactttaaagtttaattttaacttaaccgttttacggttaccggttacgggtaccgttttacgggaacccgtaaaggggtaacccgtaaagggtgttaacgttaacgaccgttaacggtaaccggtacgttcgggtacgttacggtacgaacccg

SEQ ID NO: 279081 - DNA, 651 bp, Homo sapiens
  misc_feature: GYAE6OF02FG8AQ.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatagaaaactacttagctttggtaccagcagagaccaggacagcctcctaggctgctcatttacgtgggctactccgtacccgggtaactcccggggtccctaggaccgattcgaggtggaccgtaggccggggtcgtcgggtaacctaggtactttccacgtccgtccaaccattccgacgaccgacgtcccgttaggcctagggcctagtaagtagttcggttacgggtacttaaggttttaatttaacgttagttaccgaaacttaattaacttttaattaacttacgtttacgtacggttaccggtttccgaccgggtaacgggacccgtaaagggtacggtaacgttagtaccgtaacggaaccggtaaacgttcggtacgggtacgtacgtacccg

SEQ ID NO: 279082 - DNA, 547 bp, Homo sapiens
  misc_feature: GYAE6OF02G65LQ.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaatcttttatacagttccaacaatgaaaactacttagcttggtaccagcagagaccaggacagcctctaggctgctcatttactgggcatcgtacccgggatccggggtcctgaccgattcagtgcagcggtctggacagactttcactctcaccatcagcagcctgtaccaggctagaagtatgtcggtctagtttattagttagtacaaactaactaatttaacttattaccgttcgtacgtaccgtttcgaccgaacgggtaaccgtaaggtacggtaacttagtacaacgtacgtaacgtaggtggacgtgtaccc

SEQ ID NO: 279083 - DNA, 682 bp, Homo sapiens
  misc_feature: GYAE6OF02JBQ7F.19.71.G05.1.454.CMB.1.raw
  modified_base (222)..(222): a, c, t, g, unknown or other
  misc_feature (222)..(222): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctcncgctcacctgtcgccatcgtccggggacagacgtcgctagcgacagtgtgcttggcacgtgggtcaggcacgtcccagtcggagtggtctaggaggtggacgtaggggaacggactaatttactttcaagttcgtaccaaacgtacgtaggtaaataaactaaagtttacgtacgaccgtaacctaacgttacgtttggtttaggaacggtacggttaccggtaacgtacggtaaacctaaacgttaacgaaaccggttaggaaacctaacgaaccgttaacggaaacgtaacccgttaacggtttacccgtacccgtacgacgtaacgtaccgttaccgtacccttcggttacgtaccggacctacccgggtacggtaacggtaaccgggttagttaacgttaacgttaacgttacgggttacggaaccggtacccggtaaccccgtagtacggaaccg

SEQ ID NO: 279084 - DNA, 763 bp, Homo sapiens
  misc_feature: GYAE6OF02HQIPK.19.71.G05.1.454.CMB.1.raw
  modified_base (359)..(359): a, c, t, g, unknown or other
  misc_feature (359)..(359): n is a, c, g, or t
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctctggtgcccgacggggacatcgtgatcgacccagtctccagacctcccgtggctgtgtctcgtgggcgagcgggccaccatcaactgaccaagtccacgccaactaacttacttttaatactaacgttacccaaactaaatacgtaaaaaccttacttaacgtacttacggtaaccagacagacgaccaggacacgcctacgtaggctcgactctactttacgnggctacgtaccgtaccgggacgtccggggtacctcgaccgtactcgaggtcggcgacggtcgggtcgtacgggtactaggtactttcactactaccgtaacctacgtcgacgtccgacgtcccgtacggaccgtacgggtacgttaacggaaacgtacggttcgggtacggttaaccgttttaaggtttttaacgtttacggtttaacgttaaaccgtaaaacgtttaaattttaacttttaacgttttaaccgtttaacgtttaacggggttacggttaaccgggtttaccgggtaaccgggtaaaccggggtaaaccggttaaggggttaacggtaacgttaacgtaccggaacggttaaccggtaaccggtttcggggtaacggtaccgtacggtaacccg

SEQ ID NO: 279085 - DNA, 669 bp, Homo sapiens
  misc_feature: GYAE6OF02F8S1G.19.71.G05.1.454.CMB.1.raw
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgacgtgactaagtccagccacaatctttanacagttccaanatagaaactactagcttgtaccagcagagaccaggtacagtcctactaggctgctacatttacgngacagtccgtaccggagtcccggtacctagtacgtactcgacggtcgacgtacggtcggtatacgggactacgtactttccgaccgttcctaccgtaaccgtacttaccgacgtaccgtaccgtccgtaggtaccgtacggtacgtacggtaacggttacgttacggtacgtaccgtttaagttttaacgtttacgtacgttaaccgtaaacttaagttaactttaacgtttaacgttacgtttacggtaacggttaccggttaccggaaccgtaacgggtaaccgtaagggtacgtaacgttacgtaacgtaacggtaaccggtacgtacggtacggttacgtacgtaccg

SEQ ID NO: 279086 - DNA, 720 bp, Homo sapiens
  misc_feature: GYAE6OF02H2N8N.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactcccgtggctgtgtctctgggcgaggccgggccaccgatcaactgacaacgtccagccaactaattcttttaatacacgttaccaactaatagaaaaccccccctatagtctgtaccagcagacgacaggacacgcctccgagctgcctctagtttacgtgggctacgtaccgtacccgggtaacgtcccgggggttccctacggtaccgtacttccgacggtcggacgaggcgggttcgtacgggaactacgtactttacgtaccgttacgtacctaccgtacttaccgaacggcctacgcccgtggtacccgtaacggtcgttaacggtaacgtacggttcggttacggtacgtttaacggtttttaacgtttagttttacgtaacctaaacgttaaatttaagttttaagttttaacgttacgttttacgggtacgggttaaccggtttaccgggaacggtaaacgggtaaccgtaaagggttacgtaacgtacgtaccgaacggtaaccggtaacgttcgggtacggtccgtagtaacccg

SEQ ID NO: 279087 - DNA, 666 bp, Homo sapiens
  misc_feature: GYAE6OF02G0DA8.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaactaatagaaaactacttaagcttaggtaccagcaagacgaccaggacacgcctacctaggctgctcatttacgcgggcactaccgtaacccggggtaactcccggggttaccctcggaaccgtagttccaggttcggacgaggtcggggtctgggacaggtactttacaccttcctacgtaacctagtaccacgacctacgtcctggcccaggtacgtagaaacgtgtacggtcggtaacgtttagtttaactttgttaacgtactaaacttaatttaattttaattaactttacgtttacggttacgggttaccggttaccggaaccggtaaacggggtaacctaaggggttagaaacgtttagttaacgaaccgggttaacgttacgtacgggtttacgaccgttaggaacccg

SEQ ID NO: 279088 - DNA, 729 bp, Homo sapiens
  misc_feature: GYAE6OF02GQXUJ.19.71.G05.1.454.CMB.1.raw
  modified_base (266)..(266): a, c, t, g, unknown or other
  misc_feature (266)..(266): n is a, c, g, or t
  modified_base (351)..(351): a, c, t, g, unknown or other
  misc_feature (351)..(351): n is a, c, g, or t
  modified_base (565)..(565): a, c, t, g, unknown or other
  misc_feature (565)..(565): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcattctctgttgctctggatctctggtgcccacggggacatcgtgatgacccagtctccagactccctggctgtgtctcgtgggcgagccgggaccaccatacgaactgacaagtccagcccaactattcttttacaacgacttaccaanaatagtaaaacttattagcttaggtaccagacagacgaccaaggacacgtcccgtacctaggcctgtcctacttagttttaccgngggactaacgttacccggtaacccgggaaccgtttcccgggggttacccaccggtaacccgttacgtttaccgacgggttcgggtaccgaacggggttcccgggttaccggttaggggaccgtaacggttacttttacccaacgtttccctaacccgaaccgtaactaccggacgtacgaccgtcgtcggaccctagggcctaagtaaacggtnttcggacgtacttaagtttttacttacgttactaacgtaaacttaaattaactttaattacgtttacggtacgggttacggttaacccggttaccgggtaaccggtaacgggtaaccgtaagggttacgtaacttacggtacgtaacggtaccgtaaggttcgg

SEQ ID NO: 279089 - DNA, 617 bp, Homo sapiens
  misc_feature: GYAE6OF02G68IX.19.71.G05.1.454.CMB.1.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcggccacatcaactncagtccagccacatctttanacngtaccaanatagaaactatagtctaggtaccagcagacgaccaggacagcctacgtaggctgcttctaatttacgcgggtcacttaccggaacccgggtacgtccggggtaccctagaccgtattcgaggtcggcgacggtcggtcgtaggactagtacttcactctacacatcaggctacgcgtagcgaggtataacggaacgtgttccggtagtactttaagttttacttaacgttacgttaaactaacgttaaatttacttaagtttacgttacgtttcgggttaacgtaccggttacgggaaccgtaacgggtaaccgtaagggtacgtaacgttagtacgtaggtaaccgtaacgtgggtacgtcgacgtacc

SEQ ID NO: 279090 - DNA, 668 bp, Homo sapiens
  misc_feature: GYAE6OF02GSXF3.19.71.G05.1.454.CMB.1.raw
  modified_base (247)..(247): a, c, t, g, unknown or other
  misc_feature (247)..(247): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggcgggccacatcaactgacaacgtccagccactaattacttttanactacgttaccaaactaatagaaaactacttagcttaggtaccagacagacgaccaggacacgcctacctaggctcgctctactttacgtcgggactacgtaccgtaacccggggtaacgttccccgggggtaccctacggaccgtattcgaggtcgggcgtaggtccggggtacgtacggggacctagtactttacaccgtctaccgtaccactccgacgacacgacctgacgaggtctaggaacgtgttaggcggtacttaaggttttacttagttacgtaactaactaattatttaaattacgttacgttcggttacggtaccggttaccggaccggtaacgggaaccggtaagggttacggtaacgttacgtaacgaacggtaaccgtaacgttagggtacgtacgttacgtacccg

SEQ ID NO: 279091 - DNA, 668 bp, Homo sapiens
  misc_feature: GYAE6OF02G6FJU.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccacgccaactaattcttttaatactacgtttaccaaactaataagaaaacttacttagtacttacggtaccagacagacgaccgaggacacgccctcgtaggctgccttactacgtttacgtgggctacgtaccgtacccgggtaacgtcccggggtccctgaccgtattcgaggtcggacgtcggtacgggtacgtacgggactagttactttaccacgtcctacctaccacgtaccgacgccgtacgcccgtagccggacggtcgtaaggaagtacttgggtacgtacgtttagtttacttagtacgttactaaacttaatttaatttaactttacgttacgttcggttacggttaccggttaccgggaccgtaaacgggtacctaagggttcgaacgttacgtaggaacgtaccggtaccgttggtccggacgtacgtaacc

SEQ ID NO: 279092 - DNA, 547 bp, Homo sapiens
  misc_feature: GYAE6OF02HTP20.19.71.G05.1.454.CMB.1.raw
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacaactgacaagtccagccacaattctttanacagttccaacaatgaaaactacttagcttggtaccagcagacgaccaggacagcctctaggctgctcatttcngggcatccgtacccgggaatccggggtcctgaccgtattcagtcggcaggcgggtcgtgggacagtattcactctcaccatcancagcctgcagctagagntgcgctagtttattagttacgactaacgtaaattattaacttaattacgttcgtggtaccgttcggacgaacgggaccgtaaggtggtaattacgtacgaacggtacgtaacttggtacgtcgtgtacc

SEQ ID NO: 279093 - DNA, 510 bp, Homo sapiens
  misc_feature: GYAE6OF02H0Y9P.19.71.G05.1.454.CMB.1.raw
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccagtcgagaggtctagngtggcgtgggagacatattcatgtaccaacacgtggaatacaaatttatgacaccatcgtgttgagtagtcgactgacaatacaacgtagacacatacgaagaaccagttcctacctgacacgctagacctcgtgtacgactccggacggtacgacgggtgtatattacgtggtaggaagacggccccagtaacg

SEQ ID NO: 279094 - DNA, 604 bp, Homo sapiens
  misc_feature: GYAE6OF02GQTU9.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagtactctcgtgcacgaccggtgctcgatttagtgtcgtcgcaagagagaggggggaggtacaacaggcaggcaggggcagcaagatggtgttgcaaacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagcagagaccaggacagcctcctagctgctcatttacgnggacatccgtacccgggaatcccggggtcctgaccgattcagtgcagcgggtctggacagtattccactcncaccatcgancacgctgcaggctagaagntgtcgactagtttattagttagacaaacgtaattaatttaattaacgttacctttacggtacggtacgggtttaccggacccggtaaaaggggtaccccgtaaaggggttaacggtaacttaaacgttaccgtaaacggtaaccggttaacggttagggtacggtaccggttacggacccgtaacccgg

SEQ ID NO: 279095 - DNA, 704 bp, Homo sapiens
  misc_feature: GYAE6OF02FSN9T.19.71.G05.1.454.CMB.1.raw
tcagtactctcgtgcacgaccggtgctcgatttagtgtcgtcgcaagagagaggggggaggtacaacaggcaggcagggggcagcaagatggtgttgcagacccaggtcttcattttctctgttgctctggatctctggtgcccacggggacatcgtgatgacccagtctccagactccctggctgtgtctctgggcgagcgggccaccatcaactgcaagtccagccacaattcttttatacagttccaaacaatagaaaactacttagcttggtaccagcagagaccaggacagcctcctacggctgctactatttactggggacattccgtaccccggggaacgtccccgggggtaccctggacccgtattccgaaggttcgggacacggtcggggtcgtacggggaccaagtacgttttcaccgttcctaccacctaacgttaccgacgtaccaccgtcccgtaggaccgtaacgggtccgtaacggaaagtagttcgggtcgggtaacgttagtttttaacgtttatttacggtactaaacgtaaatttaagtttaatttaaacgttaccgttttacggtacgggttaacccggttttaccgggaacccgtaaacgggggtaacccgtaaaggggttaggaactttaagtaccgtaaggaccggttaaccgttagggtacgggtccgttaggtaccccg

SEQ ID NO: 279096 - DNA, 593 bp, Homo sapiens
  misc_feature: GYAE6OF02GR7EC.19.71.G05.1.454.CMB.1.raw
  modified_base (321)..(321): a, c, t, g, unknown or other
  misc_feature (321)..(321): n is a, c, g, or t
  modified_base (566)..(566): a, c, t, g, unknown or other
  misc_feature (566)..(566): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacagtccagccactaactctttagacagttccaacatacgaaaactcttagcttcggtaccagtcagacgaccgaggacagcctcctaggcctgctcatttacgnggcacgtctacccgggatccggggtcctggacctattcagtggacacggtcggtctgggactagtactttccgactcgtaccacgtactccgtacggactaccggtcctgaccgtaggtccgtacgaaaggtcttggtacgtactttagtttagttacttacggtactaaacgtaaatttgtttaaattacgttacgttcgtacgtacggttccgtaccgtagggtaactaagggtgtaactagngaacgtacgaacgtgtacggctgaccg

SEQ ID NO: 279097 - DNA, 614 bp, Homo sapiens
  misc_feature: GYAE6OF02GI7HZ.19.71.G05.1.454.CMB.1.raw
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (470)..(470): a, c, t, g, unknown or other
  misc_feature (470)..(470): n is a, c, g, or t
  modified_base (587)..(587): a, c, t, g, unknown or other
  misc_feature (587)..(587): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatcgacccagtctccagctcctggctgtgtctcgtgggcgtagcgggaccaccatcaactgcaaggtccagccaacaattcttttaacgtacacgttaccaaacaaacttacgaaaaactactttagacttggtaacccagccanacgacagcagccctcagtccngctcacgtttcgtggacatccgtaccggtaacgtcccgggtacctcggaccgattcgaaggtcgcacgggcggtctgggacngactttcacgttntaccgactatcgacnctcgaccctggacctaaggtcctggaaaacgngttggtaccggattaacgttttattacgtcgttaaccgaaaattacgttaacttaagtttattaccggttgtaccgggttacggtccgtacggtaaaccggtacgacggggtttaanacgttactacggaacgtacgtacgtcg

SEQ ID NO: 279098 - DNA, 520 bp, Homo sapiens
  misc_feature: GYAE6OF02FSEKC.19.71.G05.1.454.CMB.1.raw
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggcgtgggaagcatatttcatgtaccaacacgtaggaaataacaaatttatgacaaccatctgttgagagtcgactgacaatacaaacgtagacanatacgaanaacctagttcctaccctgaccagctacgacctctgtacgaccgtccgaaggaccacgggtctattattacgtggtacggaacggacgtaccccagtaacg

SEQ ID NO: 279099 - DNA, 637 bp, Homo sapiens
  misc_feature: GYAE6OF02ITR5Z.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctccgctcacctgtgccatcgtccggggacagagtcgctagcgacagtgtgcgttggcacgtgggtcaggcacgtcccagtcgagaggtctagaggtggcgtggggaagtacagttattacattcgtaccgaaacgtacggtaggaaactaactaaaagtttagtcgacctaacctagttcttggttaggagtagtcgactgaacaatacaacgtagaacgacacgtacgaaacgtaacctacggttacctacccgtgaccgtacgtaccgtaccgtaccttacgttcgtaccgtacccgtacccggtacgggtaaccggtaacgggtttacggttaatttaaccggtttacggtttacgggtaacggggtaaccgggtaccccgggaacccccttaaggtaacccgtaaccgg

SEQ ID NO: 279100 - DNA, 572 bp, Homo sapiens
  misc_feature: GYAE6OF02G12XY.19.71.G05.1.454.CMB.1.raw
  modified_base (336)..(336): a, c, t, g, unknown or other
  misc_feature (336)..(336): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggacatcgtgatgacccagtctccagactccctggctgtgtctcgtgggcgagccgggccaccatcaactgcaagtccagccacaacttcttttaatacacgttaccaaacaactagaaaaccttacttaagtctttacgggtaccaggctagacgaccaggacagccctctaggtctgctcatttaccgngggcatcctaaccggggaagttcccggggtcctgaccgtacttcaggttggctaggcgggtctgggactagtactttcactctacacatcagcagcctgcgagtctagaagtcttgtcggtctagtttattattagtacaaacttaagttaatttacttaacgttacttagtacggtaccgttcgaccggaaggtaccaaggtacgtatacgagacgataccgtgtcgctgtaccg

SEQ ID NO: 279101 - DNA, 595 bp, Homo sapiens
  misc_feature: GYAE6OF02FXT06.19.71.G05.1.454.CMB.1.raw
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaacttcttaagcttagtaccagcaagacgaccaggacacgccctccgtaggctggcttacatttacgtgggcatccgtaacccgggagtcccggggtccctagaccgtattcgagtcggcgacggcggtcgtggacagtacttcactctcaccatcancagtcctgccgaggctagaagtgtggtgtactagttttaattaacgttgtactaaacgttaattaacgtttattaattaccgttggtacggtaccgttacggaccgtaagggtaccgtaagggttcggaacgtttacgaccgttaacggaccgtaaacgttcggtacggtacttacggaacc

SEQ ID NO: 279102 - DNA, 583 bp, Homo sapiens
  misc_feature: GYAE6OF02GE4PW.19.71.G05.1.454.CMB.1.raw
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaattcttttanacagttccaacaatagaaaactcttagcttaggtaccagcaagacgaccgaggacagccctccgtaggctgctctatttacgngggacagtccgtaacccgggaagtcccggggtaccctaggacccgtattccagtggacaggtcggtctagggacagtactttccacttctacaccatcagcacgtcctgctaggctagaagtatggtaggtaccttagttttattagttcgtactaaacgtattaattattacgtttacttcggtaggttaccggttaccggaccgtaacgggtaccgaagggttcgaacttagtacgacgtaacgtattacgg

SEQ ID NO: 279103 - DNA, 629 bp, Homo sapiens
  misc_feature: GYAE6OF02GQVYE.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttatacagttccaacaatgaaaactacttagcttggtaccagcagagaccaggacagcctacctaggctgctcatttactgggcatctacccgggaatccggggtccctgaccgattcagtggcaggcggtctgggacagtactttcactctccaccatcagcagcctgcgagtctagaatagtggtgaccttaggtttattagttacgtacgtaaactaaagtttatttaatttaacgttaccgtttaacgggttacggttaaccggttttaccggggaccgtaaaaccggggggtaacccttaaaacgggggttcggtaaacgtttaacggttaccgtaaacgggtaaacccggtaaacgtttccgggtaacggtcccgttacggaacccccg

SEQ ID NO: 279104 - DNA, 712 bp, Homo sapiens
  misc_feature: GYAE6OF02I1JZ0.19.71.G05.1.454.CMB.1.raw
  modified_base (250)..(250): a, c, t, g, unknown or other
  misc_feature (250)..(250): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagccgggaccaccatacgaactgacaacgtccaacgcctaacattctttaanacacgttaccaataactagtaaaactcttaagtcgttaggtaccagacacgaagtaccaacggtacacggtcctacgtaacggctgtactacgtactttacgtacggctacgttaccgaaccccggggtaacgtcccggggtacccttagaaccgtactttcgaacggtcgggaccgtcggtaccggttccgtacggggaactaacggttctttaacctcggacctttaccgaaccacttaccgacggtaccgtacgtccgtcgacgtacggtacgtagaacgttcgttaggtaccggttattaacggtttaattacgggttacttaaccgtaaactaagttttacttaacgtttaacgttaaccgtttgtaacggttacgtaccggtaacggtaacggaaacgtacggtaacgtagttaacgtccgtaaggtaccgtaagtacggtcgacgtacggtaccc

SEQ ID NO: 279105 - DNA, 580 bp, Homo sapiens
  misc_feature: GYAE6OF02FKN8W.19.71.G05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (381)..(381): a, c, t, g, unknown or other
  misc_feature (381)..(381): n is a, c, g, or t
  modified_base (479)..(479): a, c, t, g, unknown or other
  misc_feature (479)..(479): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcacgacccctctcgcctcacctggtcnccatcctccggggacagagtcgctagcgacagtgttgcttggcactgggtcaggcacgtccccatcggagaggtctagnggtggctaggggaaggacagttatttcattgtaccaacacgtaggaaactaacgaaatttancgacaacctatcttagttgacgacgtacgactagaacaaactcaaacgtacaacgaactagtacgaacgtaaccacgttacctccctacgccgagtcnccgtaactcgtagtcgaccgtccggtaaggaacgtacgggtacgttaacgttacttacggttcggtacgggaaccggtaccggacccctagtaggtaaccg

SEQ ID NO: 279106 - DNA, 671 bp, Homo sapiens
  misc_feature: GYAE6OF02H6TKS.19.71.G05.1.454.CMB.1.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (659)..(659): a, c, t, g, unknown or other
  misc_feature (659)..(659): n is a, c, g, or t
tcagtactctcgtgcacgaccggtgctcgatttagtgtcgtcgcaagagagagggggagggtacaacaggcaggcgaggggcagcaagatggtgttgcagacccaggtcttcatttctctgttgctctggatctctggtcgcccgacggggacagtcgtgatcgaccctagtctcccagacctcccgtggctcgtgtctcgtgggcgacgcgggccacatcaactgcaagtccagccanaacttctttaacagttaccacaatagaaacctatagtcgtgtaccanacagacgaccaggacagcctccgtagcgttcnctactaacgttttacgagggactaacgtacccggtaacccggggtaacggttccccggggtacccctaggaacccgtaacgttcgtaacggtcggtacgacggtccggggtaacgttggggaaccaggttacgtttacactccgttaccacgtaacgtcgaacgcgaccgtcccgttagacccgtaggtacctaagggagtaacctggtacggtcctagtttaagttacgttacgactaactaaataattataagtcgttaccgtagggtactaccggaccggtaacgggacgtaaaggtggaaacttacgtaccgtaaggaaacccgtgttaccggggtnaccgttacgacg

SEQ ID NO: 279107 - DNA, 552 bp, Homo sapiens
  misc_feature: GYAE6OF02ITCDJ.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctcttcctcttcttcctgcccgtgctgggcctcccacaaggtgtcctgtcacaagtacagctgcagcagtcaggtccaggactggtgaagccctcgcacgaccctctcgcctcacctgtcgccatcgtccggggacaggacgtcgctagcgacagtgtgcttggcacgtgggtcaggcacgtccccagtcgagtggtctaggagtggcgtagggaacgactagttattcagttcgtaccaacgtacgtaggaaatacgtaaatttatgaccacctatcgttgttagagtagtcacgtgaacagtacaacgtacacactacgacgaaacgactacgttcctaccgtgcacgtctacgtacctgtcgtacgaccgtaccggagtacggtacggtactagttactacgtacggtaggaacgaccggtacccagtaacg

SEQ ID NO: 279108 - DNA, 548 bp, Homo sapiens
  misc_feature: GYAE6OF02I0028.19.71.G05.1.454.CMB.1.raw
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggcgagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggtactggtgaagccctcgcagaccctctcgctcacctgtcgccatccgtccggggacagagtcgctagcgacaggtgttgcttggcactgggtcaggcagtccccatcgagngtctagagtggctgggaagacatatttcatcgtaccaacgcgtaggaactactaaattntcgcaccctatccttggtgaggtagtcgatagacaatcaagtanacatatcgaagtacctagttcctaccgtgacctagtcctcgtaacccgtcttgtaccgaccgtacccggaagggtactcgggggttatattaacgttcgtcggtacggaacggtcccgtaccccgtagtaaccgg

SEQ ID NO: 279109 - DNA, 579 bp, Homo sapiens
  misc_feature: GYAE6OF02IGDEU.19.71.G05.1.454.CMB.1.raw
  modified_base (238)..(238): a, c, t, g, unknown or other
  misc_feature (238)..(238): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaacttacttagcttggtaccagcaagagaccaggacagcctacctaggctgctcatttacgngggacagtcacccgggaatcccggggtccctgaccgtatcgagtggcaggcgggtctgggacagtatttcacgtctcaccatcagccagccctgcgaggctggaagtagtgtgactagtttatattgtactaagtaattaattactttaatacgttacgtaggtacgttaccgggaccgtaagggtaacccgtaagggtacgtaaagttacgtaccgtaacggtaaccgtaacgttacgggtaggtaccgtagtaacccg

SEQ ID NO: 279110 - DNA, 664 bp, Homo sapiens
  misc_feature: GYAE6OF02G0KBV.19.71.G05.1.454.CMB.1.raw
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
  modified_base (402)..(402): a, c, t, g, unknown or other
  misc_feature (402)..(402): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgcaacgtccagccaactaacttcttttaanactagttaccaaactaatacgtaaaactacttagtcttaggtaccagactagacgaccaggacagcctacgaggctgctctatttacgngggctactccgtacccgggaactcccggggtaccctggaccgtattcgagtcggcaggtcgggtcngggacagttattccgactccgtaccactactacacgtcacgtcctgaccgtagggccttaaggaagtacgtgggtacgtacgtttaagttttaacgttagttacgttaaccaaagttaaagttttaatttaaagtttactttaaaccgttcgggttacggtaaccgtttccgggaaaccggtaacggggtaacccgtaaaggggtcgttaagtaacgtacgaacggtaacgtaacggttcggtacgggtcctacggtaaccc

SEQ ID NO: 279111 - DNA, 504 bp, Homo sapiens
  misc_feature: GYAE6OF02GXXY6.19.71.G05.1.454.CMB.1.raw
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (495)..(495): a, c, t, g, unknown or other
  misc_feature (495)..(495): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggaatccggggtccctgaccgattcgagtggcaggcgggtcgtgggacagtatttcactctcaccatcagccagcctgcaggctgaagatgtgctagtttattattntacaanaatattattatacttgtggtacgttcggacgaaggaccaaggtgatatnagacgatgg

SEQ ID NO: 279112 - DNA, 747 bp, Homo sapiens
  misc_feature: GYAE6OF02GG5QM.19.71.G05.1.454.CMB.1.raw
  modified_base (245)..(245): a, c, t, g, unknown or other
  misc_feature (245)..(245): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccgatacaactgacaagtccagccaacaattcttttaanactacgttacccaaacaatacgtaaaaacttacttagtcctttacggtaacccagtacaaggaacgaacccgaagggaaccaacggtcccttacccgtagggtcctcggtccttacctaagtttttaaccggtggggtacctaaccgttacccggtaaaccccgggggtaaccgttcccccggggggtacccctaggaacccgttacttaccgaagggttcggaccgtacgggtccggggtcgtacggggaactacgttaccttttccgaacgttcctaccaaccacgtccaacggccaacggtcctaggaccgaggtaccgtagaacgtaggttcggtagggtactttaaggttttaacttagttacgtaacctaaattatttactttaagtttaacttacggttacgtacgggttaccgttacggaccggtaacggggtaacctaagggtcgtaacttacgtacgacggtaaccgtaagttggacggaccgttcgaaccc

SEQ ID NO: 279113 - DNA, 725 bp, Homo sapiens
  misc_feature: GYAE6OF02GF2V3.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccacgccaacaattcttttaanactacgttccaaactaatacgtaaaactacttagctttacggtaccagcagacgaccaggacacgccctcgtaggctcgctctatttacgtgggacactccgtaacccgggtacgtcccggggtaccctggaacccgtattccgaggtcgggacgtacgggccggggttcgtcggggaacaggttaccttttaccgaccttacctacctaacccagtaccgaccgtaccgacgtcccgtacgccggtacggacgttaaggaaagtcgttagggtcggtacgtttaagttttacgtttagttaccggttaactaacttaagtttaacttttaactttaacgtttaccgtttcggttaaccgggttacccggtttaccgggaacccgtaaaccgggggtaacctaaggggttaacggtaacttacgttaccggtaaaccggttacggtaaacgttccgggttacgggtccttacggtaacccg

SEQ ID NO: 279114 - DNA, 758 bp, Homo sapiens
  misc_feature: GYAE6OF02HG83B.19.71.G05.1.454.CMB.1.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaacgtccagaccaactaattcttttaanacacgttaccaacaatacgtaaaaactacttagcttagtaccagtcaacgacgaccaggacngccctacgtacggctgtcctctaagtttacgcgggtacacgttaccgtaacccggggtaaacgttccccgggggttaccctacggtaacccgtacttccgaacggttcgggaccgacgggtccggggtacgtacgggggaacctaggttacctttttccgaaccgttccttaccgaccctaacgtaccgaacggtaccacgtaccgtcggaccgtacgggtacgtaacggaacgtaacggttcggtacgggtactttagggtttttaactttacggtttaccgtaaccgtaaacttaaacgttttaactttaagtttaacgtttaccgttaggttaccggtttaccgggttaccggaaccggttaaacggggtaacgtaacggggttaacgtaacgttaacgtacgaacggttaacggtaacggttcggtacggtaccgtacgtaacccg

SEQ ID NO: 279115 - DNA, 860 bp, Homo sapiens
  misc_feature: GYAE6OF02H661W.19.71.G05.1.454.CMB.1.raw
  modified_base (258)..(258): a, c, t, g, unknown or other
  misc_feature (258)..(258): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgacggcgggccaccgatacaactgacaacgtccacgaccaactaatttcttttaanactacgttacccaataaactaacgtaaaaccttaacgttacgtaccgtttacggtaaccagaccgaacgaacggaacccgaaggacctaaccggtaccccgttaccgtaacggccttcggtaccttacgttaacgtttttaccggcggggtacccttaaccggttaccccggggttaaacccggggtaaccgggtttccccggggggttaacccctaccgggttaacccggttacgttacggtacgggtcgggtacggtacggggtccggggttacgtaacggggaccgttacgttaacttttacccgaccgttacctaccgtaacccgtaacgtaccgaacgtaccgtaccgtaccgtaccgtacggtacggtaccgtaacggtaacgtacgttacggttacggacgttttttttttttttttaagtaagttttacgttaacgttaccgtaaacttaactttaactttaaacgtttaacgttacgttaacggttacggttaccggttaccgggtaaccggtaaccgggtaacggtaacggttacggtaacgttaacgtacggtacgtaaccggtacgttacggtacgtaccgtacgtaccg

SEQ ID NO: 279116 - DNA, 679 bp, Homo sapiens
  misc_feature: GYAE6OF02G5L5F.19.71.G05.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgacggggacatcgtgatgacccagtctcagactcctggctgtgtctcgtgggcgagcgggccaccatcaactgacaacgtcagccaactaattctttanactacgttaccaacaatanaaaactntagctagacagcagacgacgagacacgcctcgtaggctcgctactatttacgnggctacgtccgtacccgggtaagtccgggcctaggaccgttatcgaggtcggacgacggtcgggtcgtagggactaacggtactttcgacttccgtaccactacgtacgaacgctacgaccgttggacgacggcgttaaggaacgtaggtcgtaggtaacgtttaagttttaacgttacggttaactaaccgtaaaacgttaatttaacgtttaacgtttaacgttaccgttttacgggacgggtttaccggttacggtaacccggtaaaggggtaaccttaaggggtacggtaaaccttaggttaaccgaacggtaaaccggttaacggttcgggtacggtaccgtaccggttaaccg

SEQ ID NO: 279117 - DNA, 721 bp, Homo sapiens
  misc_feature: GYAE6OF02I533C.19.71.G05.1.454.CMB.1.raw
  modified_base (190)..(190): a, c, t, g, unknown or other
  misc_feature (190)..(190): n is a, c, g, or t
  modified_base (257)..(257): a, c, t, g, unknown or other
  misc_feature (257)..(257): n is a, c, g, or t
  modified_base (338)..(338): a, c, t, g, unknown or other
  misc_feature (338)..(338): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggacatcgtgatgaccctagtctaccagacctcccgtggtctgtntctcgtgggcgaggccggaccacataccgaactgacaacggtccacgaccaactaattccttttaanacctaacttaccaaactaatacgaaaaacttcttagctttacggtaccagcaagacgaccgagacacgtcctcgagtcgtntctacgtactttacgcggtcaagtccccggtaaccgggtaacgttccccggggtaccctacgtaaccggtcttacggtacgggttcggacgtacgggtcggggtcgtagggaaccgttaagttccgtttacacttccgtacaacgtacgactggtccacgtccgtcgacgaggtaccgtaggtaagtaccgttggtacgttactttacggtttttaagagtttaaccgactaaacttaaagtttaatttacgtttaacttacggtttaaccgtacgggttaccgttaccggtacggtaaaccgggtaccgttaaaggggttacgtaacgtttaccgacggttaacggtaacccgtaggttacggacggttccgtacgtaaccg

SEQ ID NO: 279118 - DNA, 690 bp, Homo sapiens
  misc_feature: GYAE6OF02JJN6R.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggagggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacacgttccaacaatagaaaacctacttagcttcggtaccagcaagacgaccaggacacgcctcctaggctgctacatttacgtgggacacttacgtacccgggaagtcccggggtccctaggaccgtattacacggtggacgaggtccggggtcgtaggggacaggtacttttccaccgttccgtacaacccgtattcccgaaggtccgacgtcccgttaggccgtaagggtctaggaaagtgtcggtacggtactaggtttttaatagttcgtaaccaaacgtaatttagtttaacttacgttaaccgtttcggtagggttaacccggtttacggaaccggtaaacggggtaacccgtaaagggttaggtaaacctttaaggttaacccgaaacggttacccggtaaacggtttcgggttaccgggttaccgttcccgggtaaacccg

SEQ ID NO: 279119 - DNA, 780 bp, Homo sapiens
  misc_feature: GYAE6OF02JGFJ3.19.71.G05.1.454.CMB.1.raw
  modified_base (246)..(246): a, c, t, g, unknown or other
  misc_feature (246)..(246): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaagtccagccactaattcttttaanactacgttaccaaactaataacgtaaaacttacttagacttacggtaaccagacaaggaacgaccgaggaccacgccctaccgtaggctgtaccttacgtaatttaccggtcgggtacctacgttaccccggtaacccggggtaacggttccccggggtaccctacggtaaccgttattaccggtaggtacggccgtacgggtccgggttacggtacggaacgtacgttacgtttacctaccttaccgtacccaccgtaagtacccgaagtccctaaccggtccgtacgggacgtacgggtaccgttaaggaaacgttacggttgggtacgtacctttaagggttttaacttcggtttaacggtaactaaaacgttttaattaacgttttaacgtttaaccgtttacccggttacggggtaccggtttaaccggttccgggaaaaccggtaacggggtaaacccgttaggggttaataaccgttacgtaacggaacggttaacggtaccggttagggtaccggtactacgaccg

SEQ ID NO: 279120 - DNA, 804 bp, Homo sapiens
  misc_feature: GYAE6OF02I8N17.19.71.G05.1.454.CMB.1.raw
  modified_base (249)..(249): a, c, t, g, unknown or other
  misc_feature (249)..(249): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacgggacatcgtgatcgacccagtctccagacctccctggctgtgtctcgtgggcgaggccgggccaccatcgaacgtgacaacgtccagccaactattctttanacctagttaccaaacaataacgaaaacttcttacgtccgtttacggaacctagaccgaacggaacgaaccgtacgggaaccacgtaccccgttacgtacggctcgtaccttacttacgtttacgacggactacgttacccggtaacccgggtaacggttccccggggtaccctacggtaaaccgtcgttaccggacggtcgggaccgtaccgggtacgggtaccgtacgggaacctaggtttaccttccgaaccgttcctaacccaacggtctaccgaacggtccctaggtacccggttcgaccggtacggtaccggttaaggtaaaccgttggggtaacgttaccgggtttacgtttaaacggtttttaattaaacggtaccgtttaaaccgtaaacgtttaacttttagtttaactttaacccgtttacggtcgggttaaacggttaccgtacccgggtaaacggttaacgggaaaccgttagggttactaaccgttaggtaacccgtaaggttaaacccgttgggttaccgtacgtacgtacccggtaaccc

SEQ ID NO: 279121 - DNA, 575 bp, Homo sapiens
  misc_feature: GYAE6OF02FQMXK.19.71.G05.1.454.CMB.1.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggccaccatcaactgcaagtccagccacaattcttttaanacagttccaaacaatgaaaactacttagcttggaccagcagagaccaggacagcctctaggctgctcatttacnggcatccgtacccgggatcccggggtcctgaccgattcaggtggcaggcgggtctgggacagtactttcactctcaccatcagcagcctgcgaggctagaagatggtgtactagtttaattagttacgtacaaacttaattaatttaatttacttaacgtttgtacgggtaccgtttaccggaccgtaacgggtaccgtaaaggggtcgtaagttaagtccgtaaggaaccggtaacgttggacgggtacctggaacccg

SEQ ID NO: 279122 - DNA, 786 bp, Homo sapiens
  misc_feature: GYAE6OF02I7CI4.19.71.G05.1.454.CMB.1.raw
  modified_base (254)..(254): a, c, t, g, unknown or other
  misc_feature (254)..(254): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagactcccgtggctgtgtctgtgggcgaggccgggccaccgatacaactgacgtaacgtccacgtccaactattctttaanacgacgttccaaatatagtaaaacctcttagcttacggtaaccagtaccaagacaccgtagaccacgtccctaccgtaggctacgtcttacgtaacgtttacgtcgggactaacgttacccggtaacccggggtaagttccccgggggtaccctaggaacccgttagtaccgaaggttcggaacgtcggtaccgggttaccgtacggggtaactacggtaacttttccgaaccttccgtaccgaacctagtaccgaacgtacgtaccgtcccgttaggaaccgtacggtaccgtaaggtaaacggtaacggttcggaaccggttataaacggttttacgttaacgttacgtaaacccgttaaattaactttaaggttttaaactttaccggttaaacggttaccggttagggtaacccggttttaccggaaaccgggtaaacgggtcccggttaaaagggtcgggtaacgttaccgtaacccgtaaggttaccggaaaccggtttgggtacccgggtacttacccggtaacc

SEQ ID NO: 279123 - DNA, 692 bp, Homo sapiens
  misc_feature: GYAE6OF02FQ6PB.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctagaggtggcgtagggaaggactagttactttcatcgtaccaaactacgtaggaaattaacgtaaaatttagtacgaccaacctacttaccgttggtttaggaacggtaacgttaccggtaacgttacgaaccgtaaacgttaccgaaaccggttaacgaacctaacgtaacgttaaccggaaacgtaaacccgtaacggttttacccttacccgttacggtaccgtaacggtaccgttaccggtacccgttacgttaccggttacgtacccgtaccccgggtaacgggtaaccggttaacggggttacgttaacgtttaacgtttaacggttacgggttaacgggtaaaccgggtaccggtacccccgtagtaaaccgg

SEQ ID NO: 279124 - DNA, 666 bp, Homo sapiens
  misc_feature: GYAE6OF02JX3BB.19.71.G05.1.454.CMB.1.raw
  modified_base (211)..(211): a, c, t, g, unknown or other
  misc_feature (211)..(211): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctcgggccctcccacaaggtcgtcctgtcacaagtacagctgcagcagtcaggtccaggactgggtgaacnccccgtcgccacgaccctcgtcgccttccaccgttgtcgccctatccgtccggggactacgagtcgctaggtgacgagttgttgcttcggccacgtcgggtcacggcgacgtccccagtcggagtaggtcctaagcggttaggccgtaggggaacggactagttacttcgatcgtacccaagtacgtggtaaactaaccgaaattagtcgacgactaacgtcgttagttacgaggtacgtacggtacgtaggtaactaacgtaaccgtaaacggtaacgaacgtaaccaagttaaccgaaaccgtaaccgttaaccggttaccttacccgtacgtaccgtacgaccgttcgtaaccctgttaccgtcggtaccgtacccggacgggaaccggtacggttagttattaccgttagtacgttagggaaccttaccggaccccgtagtacgtaaccgg

SEQ ID NO: 279125 - DNA, 735 bp, Homo sapiens
  misc_feature: GYAE6OF02J2X5S.19.71.G05.1.454.CMB.1.raw
  modified_base (554)..(554): a, c, t, g, unknown or other
  misc_feature (554)..(554): n is a, c, g, or t
  modified_base (720)..(720): a, c, t, g, unknown or other
  misc_feature (720)..(720): n is a, c, g, or t
tcagtactctcgtgcacgaccggtgctcgatttagtgtcgtcgcaagagagaggggggagtacaacaggcaggcaggggcagcaagatggtgttgcagacccaggtcttcatttctctgtgctctggatctcgtggtacgcccgacgggactactcggtagactccgacccgtagttccaccagtaccctcccgtggtcttcgtcgttccgtcggtagggaccgacggcccggacccaaccgtactaccgaaccgtcgaccgtaaccgtcccgaccgtaccaactttaaccgtttccttttaaccgacgtaaccgttaaccgaaaaccttaaacgttaccggtaaaaccttcgtttacggtaccgtttaaccggacctagaacgacgtaaccggactacggacctacgttcctacgtagtctacgtctacgttacttcgacgtacctaacggtcccgtaaccggtacggtcccgtcgtacgtaccgtttcgacggtcggcgacgtccggtacggacgtacggactacgttcctaccgaccttcgaccaccgtanaccggacgacgtcgtaccggagtacaggtactagtaacgtcgtgtaacgtttattagttaaacgtcacgtaacgttaaactttcgtaacttcgtagtacccgtgggttaccaggtccaaccggtatccggagtttacacgttaccggtcgaacgtacggtccgtanccggttacacttacg

SEQ ID NO: 279126 - DNA, 811 bp, Homo sapiens
  misc_feature: GYAE6OF02HAR8X.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcccgtggctgtgtctctgggcgaggcggccacatcaactgacaagtccagccacaattcttttanacagttaccaaacaatacgtaaaaactacgttagacgttacggtaaccagaccaagtaacgaaccgaagggaccacggtacccttaccgtagggaccttgtaccttactaacgtttttacgagggtactaacgttacccgtaaccccggggtaaacgttccccgggggttacccctacgggtaacccggtacgtttaccgtaagggttccgggacgtacggggtcggggttaccgttacgggggaacctacgggttaactttttcccgaaccgtccgtttaccgaacccgtaacgttccgaaacggcctaacggtccgttaccggaccgtacgggtaccgttaagggaaacgtaagttcgggttacggaccgtttaaggttttaacctttaggtttacctaacgtaaaaccttaaagtttaaacttttaacttttaaacggttactttaacgggttacggtaaccggttttccgggaacgtaaccggggtaaccggttaaaggggttacgttaaacgtaacgtaccgtacgggtaaccgttaacgttacgggttacgtacgttacgtaaccg

SEQ ID NO: 279127 - DNA, 636 bp, Homo sapiens
  misc_feature: GYAE6OF02JDHZE.19.71.G05.1.454.CMB.1.raw
  modified_base (191)..(191): a, c, t, g, unknown or other
  misc_feature (191)..(191): n is a, c, g, or t
  modified_base (249)..(249): a, c, t, g, unknown or other
  misc_feature (249)..(249): n is a, c, g, or t
  modified_base (335)..(335): a, c, t, g, unknown or other
  misc_feature (335)..(335): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
tcagtactctcgtgcacgaccggtgctcgatttagtgtcgtcgcaagagagaggggggaggtacaacaggcaggcgaggggcagcaagatggtgttgcagacccaggtctcatttctctgttgctctggatctcctggtcgcccgacggggacagtcgtgatcgacccagtctccagactccctggctgtntctcgtggcgaggcgggccaccagtcaactcgcaagtccaggaccacaattcttttanacagttccaacaatacgaaactacttagccttagtaccagacagacgaccagaccagccctccgaggcctgctactagtttaccgngggcacttacccgtaccgggaacgtcccggggttccctaggtaccgtagtttacgaggttcggactacgggcggttccgagggacctagtctttcacgtctcccgactacncncgaccaggcctacgcgagtcagaagtagtcgacgtactagtttagtcctttacggactaaacctagttaactttacgtaactttacggttcggtacggttaacccgtgttaaccggaaccgggttaacgtaccgggttagtaactacgtacgacggtaaccgtaccgttaggacgggtactcgtaccg

SEQ ID NO: 279128 - DNA, 737 bp, Homo sapiens
  misc_feature: GYAE6OF02IC56W.19.71.G05.1.454.CMB.1.raw
  modified_base (249)..(249): a, c, t, g, unknown or other
  misc_feature (249)..(249): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggacgaggccgggccaccatacaactgaccaagtccagaccaactaattccttttaanacctagttacccaataaatacgaaaaacttcttaagtcttaggacctaagactagacgaaccgaaggaccacgacccttaccgtaggctcgcttactaactttacgcgggactacgtaccgtacccggggtaacgttcccgggggtaccctacggaccgtacgttacgacgtcgggacgtacggtccggggtacgtcggggaacctagtaattttacccgacctttacgtacccgaacccgtataccgaacgacgtacggtaccgtacgaccgtaacgggtaccttaaggaaacgtgttacggtcggtaattaacggttttaattagttaaccgtaacaaacgttaattaagttttaacttattaaccggttacggttacgggtaaccggttacggtaacccggtaaacgggaaccgttaaagggtaccggtaacttttacgacgtaacggtaacggtaaccggttaggtacggtacctaggtaaccc

SEQ ID NO: 279129 - DNA, 635 bp, Homo sapiens
  misc_feature: GYAE6OF02FKJE2.19.71.G05.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (352)..(352): a, c, t, g, unknown or other
  misc_feature (352)..(352): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtgctgtcgtctcgtgggcgagccgggccaccataccaactcgacaacgtccagacctacaattcttttanactacgttaccaaanaatacgaaaacttcttagctttacggaccagacagacgacccaggaccacgtcctaccgtaggctggcctacttagtttacgnggtacctacgtcccggtaacccgggactccccgggggtccctacggaccgtagttaccgaggtcggcgtacgggccggggtctaggggaactagttactttacacctctaccacctatcgacgtcgacgcctggaccgaggtctaaggacgttgtcgggtagtacgttatttagttacgtagtaccaaagttattatttaactattcgttgtacggaccgttcgacgtaacggtactaggtacgtatacgtagacggtagtaccgttggtcggactacgtacc

SEQ ID NO: 279130 - DNA, 671 bp, Homo sapiens
  misc_feature: GYAE6OF02FFJ0D.19.71.G05.1.454.CMB.1.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctccacaaggtcgtcctgtcacaagtacagctgcagcagtcaggtccaggactggtcgaacnccctgcagacccctgtcgctcacctgtcgccatccgtccggganacggtagtccgactagcgactagttgtgcgttggctacgtgggtcaggccacgtcccagtccgagacggtctaggacgtggacgtagggaacgtactatactttcattcggaccaaacgacgttaggaaacttaccgtaaaatttcgtacggacctaaccgtactttaccgtaggttacggaacgggtacgttaccgtaaacgtacggtaaaccttaagtaaccgtaaacgttaaccggaaccaacgtaacgttaaccggaaacgttaacccttacgtttacccgtcccgtagtacccgaagtcctacggttaacctccgttaggtccgtaaccgtcccgggtaaggaccggtacccgggttataccgtttaagttaccgtacgggtaaccggtaccgacccggtaccctagtaaccg

SEQ ID NO: 279131 - DNA, 507 bp, Homo sapiens
  misc_feature: GYAE6OF02GU1U6.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
  modified_base (484)..(484): a, c, t, g, unknown or other
  misc_feature (484)..(484): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacnggcatctacccgggatccggggtcctgaccgattcagtggcagcgggtctgggacagtatttcactctcaccatcagcagcctgcaggctgacgntgtgctagtttattattgtacaactaatatttaatacttacttgtgtacgttcggacctaagggacaaggtgattancgagacgtaacgtgtcgctgacc

SEQ ID NO: 279132 - DNA, 660 bp, Homo sapiens
  misc_feature: GYAE6OF02IB8QL.19.71.G05.1.454.CMB.1.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctcgtgggcgagccgggccaccatcaactgacagtccagaccaactaattcttttanactacgttaccaanaatagaaaaaccttnttacgtcttaggtaccagaccagacgaccagacagcctaccgtaggctgctctagtttacgnggtcacttaccgtaccgggtaacgtccggggtcctcgaccgtagtccagtcggcacggtcggggttacgtacgggtactaggttacgtttttacccagttacctaccgtaaccacttacacggcgtacgcctgaccgtaggcgtaggaagtgttaggtgggtaccttaagtttagtttaacttaggtaaccaaagtaattttaattaacgtttaattaccgtttacggtagggtccctttaccgggaccgtaaagggtacccgtaagggttagaacgttaacgttacgaaggtacgaaccgtttaggcggtactcggtaacccg

SEQ ID NO: 279133 - DNA, 690 bp, Homo sapiens
  misc_feature: GYAE6OF02HB7IH.19.71.G05.1.454.CMB.1.raw
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcccgtggctgtgtctcgtgggcgagcgggccaccatcgaactgacaagtccagccactaattctttaanacctacgttaccaaactaatagaaaacctacttagcttacggtaccagcagacgaccgaggacncgcctacgaggctgctcgtattacgtgggacctacgtacccgtaacccggggtacgtcccgggggtacccctggtaacccgtattccgaggtggcgacgggtcggggtcgtacggggacacgttactttccgacttccgtacctaccgtatccgacggactacgtccgtaggccgagggtccgtaaggtaacgacgtgggttacgtagtttagttttacttacgtttacggtaaactaacttaaatttagtttaacttacgttaaccggttcggtagggttaccgttaccggtaacggtaacggggtaacgtaagggttcgggtaattacggtacgtaacgggtaacgtaccggtgggtacggtaccgtaccgtaacccg

SEQ ID NO: 279134 - DNA, 535 bp, Homo sapiens
  misc_feature: GYAE6OF02GPIYI.19.71.G05.1.454.CMB.1.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (420)..(420): a, c, t, g, unknown or other
  misc_feature (420)..(420): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaacgtccagccacaattcttttanacagttccaacaatagaaaactacttagcttggtaccagcagagaccaggacagcctcctaggctgctcatttacnggcatctacccgggaatccggggtccctgaccgattcagtggcaggcgggtctggggacaggtactttcgactctacaccatcgagcacgcctgcaggctggantgtgtctagtttattagtcgtacaactaatattattatacttcgtgacgttcggaccgaagggtaccaaggtcgaattacgtacgaacgacggtaacgtggtacggtctagaccc

SEQ ID NO: 279135 - DNA, 698 bp, Homo sapiens
  misc_feature: GYAE6OF02HW30L.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacagtccagccaactaattcttttanactacgttaccaactaatagaaaaccttacttagctttaggtaaccagaccaagacgaccgaggaccacgccctaccgtaggctagctactagtttacgcgggactacgtccgtaacccggggaacgttcccggggtaccctacgaccgtattcgacggtcggacgacggccgggtacgtacgggacgtacgttatttaccgaacttccgtacccaaccgtactaccgacgcctacgtccgtacgcggacgtaccgtaggtaaggtacgtgggtcgtacgtttaaggtttactttacgttacgtaactaaacgtttaaattaattttaagtttacctttacggttaccgttacgggtaccggtttaccggaacggtaaccgggaaccgtaacgggtaggtaacttaacgtacggtaacggaccgttaacggttcggtacggttaccgtacgtaacccg

SEQ ID NO: 279136 - DNA, 662 bp, Homo sapiens
  misc_feature: GYAE6OF02HBGR2.19.71.G05.1.454.CMB.1.raw
  modified_base (264)..(264): a, c, t, g, unknown or other
  misc_feature (264)..(264): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
  modified_base (507)..(507): a, c, t, g, unknown or other
  misc_feature (507)..(507): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccgacggggacatcgtgatgacccagtctccagacctcctggctgtgtctcgtgggcgaggcgggtccaccgtactacaacgtcgacaacggtccaagacctacaacgttccttttanaactacggtttaccaaacaatacgtaaaactacttacgtcttacggtaccagcacgtacgaccgagacacgccgtaccgtagctcgacttacgtattacgtgggtaccagtaccgtaccggaacggttcccggggtcctacgtaccgtattacacggtacgcgtacgacgggtntacgggactagtactttacactctacacnctcgacgcacgtccgtagacgtacggctagacgtgtacgngtacgttaacgtttattacgttaacgttacaaacgtaagtttaactttaacgtttacgtacgttcggttaacgggttaacggttacccgggaaccgtaaccgggtaacgttaacgggttagaacttaaggaccgtaacgtacggtaacgttcggg

SEQ ID NO: 279137 - DNA, 750 bp, Homo sapiens
  misc_feature: GYAE6OF02H1U87.19.71.G05.1.454.CMB.1.raw
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactcgacaagtccagacccaactaattacttttaanacacgttaccaaacaatcgtaaaaacttacgttagtcttagtaccagcagacgacaggacagcctcgaggctcnctctagtttacgnggctagtccgtacccgggactcccggggtacctagaccgtattccgaggtacggcgtacgggtcgggttacgtcggggaactacgtacttttaccacgttacctaccgaacctaacgttcgaaaccgtcgtaacgtcccgttaggaccgtgggtaacctaagaaaggttacctgggtacggtacgtaaagttttttattaacggttacggtaaaccctaaaacttaaagtttaacttttaaacgtttaacgtttacccggtttaacggggtaccggttttaacccggggttttacccggaaacccggtaaagggggggttaaacccctaaaggggggtttacgtaacgttaaccgttaacggaaccggtaacgtttaaccggtacgggtaccggttaccttaccggaacccg

SEQ ID NO: 279138 - DNA, 747 bp, Homo sapiens
  misc_feature: GYAE6OF02ILQKC.19.71.G05.1.454.CMB.1.raw
  modified_base (248)..(248): a, c, t, g, unknown or other
  misc_feature (248)..(248): n is a, c, g, or t
  modified_base (498)..(498): a, c, t, g, unknown or other
  misc_feature (498)..(498): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagactccctggctgtcgtctcgtgggcgagcgggccaccatcaactgacaacgtccacgccaacaacttctttanactacgtaccaacaatacgtaaactacttagcttacggtaacagacagacgaccgaggtaccgacgaccctcgtacggctcgccttacgtaactttacgcgggtactaacgtaccggtaacccgggtacgtacccggggttccctacggtaccgtacgttacgtacgtcgggacgtacggtacgggttaccggtacgggtaacgtaacggtttacttttccaacccgtaccgttacccgaaaaccccgtnttaacccgtaggtaacccgtaccggtcccgttaacggacgtaacgggtccgttaagaaacggttacgttgggtaacggtaccgtttaaggttttacgtttaactttcggtaacctaaacgttaatttacgttaatttacttacgtttacggttccgggttaaccgtcggtaccggaacgggtaaccgtaaggtaacgtagtacgttaacgacggttaaccggtaagttacggaggtccgtaggtaaccc

SEQ ID NO: 279139 - DNA, 651 bp, Homo sapiens
  misc_feature: GYAE6OF02IW4AK.19.71.G05.1.454.CMB.1.raw
  modified_base (302)..(302): a, c, t, g, unknown or other
  misc_feature (302)..(302): n is a, c, g, or t
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtagaacgccctcgcgacgaccccttcctccgcctccacctcggtcgaccactccgtccgggggacaggagtccgctagccgacgagttgttgcttggcncggtgggtacgaggcacgtccccagtccggaggacggtacgtaggaggtcggacggtagggggaacgactaattacgtttagacttcgtaccaaacgtaacgtaggtaaactaaactaaagttatacgactacctaattcgtagttaggacgtagttccgaagttacgaaactaactacggtaaaccgtagaaacctactaacgtaccggaaacgaccttaaccgttcctccgtacgacgacgtacttcgacccttgtcgtacgtacccgtaccggacgtaaccgggacgtttaacgtaattacgtttacgtaggtacgggacgtaacccggacccctaggactaaccg

SEQ ID NO: 279140 - DNA, 685 bp, Homo sapiens
  misc_feature: GYAE6OF02I9UUS.19.71.G05.1.454.CMB.1.raw
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (487)..(487): a, c, t, g, unknown or other
  misc_feature (487)..(487): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgaggggacatcgtgatcgacccagtcctccagactccctggctgtgtctctgggcgagcgggccacatcaactgcaagtccagccaanaattctttanacacgttacaacaatagaaaactactacgtacttacggtaccacgtacaagacgaaccgtaggacaacggcccttaccgtacggctacggctaccgtatttaaccgtcggggtcctagttaccgtaacccggggtaacgttccccggggttcccgtacggtaccgtaactttcgagggtcgacgacggtaccggggtcgttcgggaacagtacgttttaccgaacttccgtactaaccgtactacncgtacgtacgcccgtagccgaggtccgtaagaacgggtattaggtagtaccgtagttttaacgtattacggtaactaacttaagtttaattagtttaacttacgttacgtacggtacgttcgggaacgtaacgggtaacgtaacggtggtaacgtagttacgtaacggacggtacgttaggacggtccgtacggtacc

SEQ ID NO: 279141 - DNA, 649 bp, Homo sapiens
  misc_feature: GYAE6OF02J08I0.19.71.G05.1.454.CMB.1.raw
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (399)..(399): a, c, t, g, unknown or other
  misc_feature (399)..(399): n is a, c, g, or t
  modified_base (478)..(478): a, c, t, g, unknown or other
  misc_feature (478)..(478): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggtacatcgtgatcgacccagtctccagactcccgtggctgtgtctcgtgggcgaggccggccaccatcaactgacaagtccagccactaattctttanacacgttaccaaacaactacgaaaactacttagtcttacggtaccagacaagacgtaccgacggacacgccctcgaacgcgtcncctacgtactttacgcggtcacgttaccgtaaccgggacgttcccggggtacctcggaccgtagttcgnggtcggcgacggtcgggttcgcggtaactcgtactttcacgtctacctaccagtacgagacgtcgtctagtcgacggtnttaacggaagtcgtcggtagtacgtttaaggtttacttagttacgtaactaaacgttaatttaactttaagttaacttacgttcgttacggtaccgtttaccggaaccgtaacggtaaccggtaagtacggtaactagtacgacgtacgacgttggagtccgtagtaaccg

SEQ ID NO: 279142 - DNA, 598 bp, Homo sapiens
  misc_feature: GYAE6OF02FX16X.19.71.G05.1.454.CMB.1.raw
  modified_base (475)..(475): a, c, t, g, unknown or other
  misc_feature (475)..(475): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagttgttgcgttggcacgtgggtcaggccacgtccccagtcggagtacggtctaggaggtggcgtaggggaaggtactattacttcagttcgtaccaacgacgtaggaaactaactaaattactcgacactatcgtagttagagtacgtcgactacggaacactaccgtaagtacgaacacgagtacgaaacgtaacctagttaccnccctagctacgtcctacgtacctgtagtccgtaccgtcccggacggtaccgtacgggttattaacgtaacgtttaacgcgggttaacgggaacggtacccggtacccctaaggtacgtaaccg

SEQ ID NO: 279143 - DNA, 747 bp, Homo sapiens
  misc_feature: GYAE6OF02JLHYZ.19.71.G05.1.454.CMB.1.raw
  modified_base (243)..(243): a, c, t, g, unknown or other
  misc_feature (243)..(243): n is a, c, g, or t
  modified_base (569)..(569): a, c, t, g, unknown or other
  misc_feature (569)..(569): n is a, c, g, or t
  modified_base (731)..(731): a, c, t, g, unknown or other
  misc_feature (731)..(731): n is a, c, g, or t
  modified_base (740)..(740): a, c, t, g, unknown or other
  misc_feature (740)..(740): n is a, c, g, or t
tcagtactctcgtgcacgaccggtgctcgatttagtgtcgtcgcaagagagaggggagggtacaacaggcaggcagggcgagcaagatggtgttgcagacccaggtcttcatttctctgttgctctggatctctggtgcccacggggacatcgtgatgacccagtctccagacgtccctggctgtgtctctgggcgagcgggcccaacatcaactcgcaacgtccagccacaattcgttttanacacgttccaacaattgaaaacttacttagtccgttagttaaccccgagacgtaacggagaaaccccgagggttaaccaacggttcccctaaccgttaacgggtctcggtcctacctaattttaaaccgtcgggggaacctacgttacccgttaaaccccgggggtaaacgtttcccccgggggttccccttacgggaaacccggttatttacccgaaggttcgggcctagggccggggttaaccgttggggggaaacctcggtaactttttacacgttacccttacgaacccttacgacctacgacgtcgtaccgtccggtaacncgggttaccaggtaacgtacgtggtacgggtactaacgggtttattagttagtacctaaataacttaattactattaacgttcgtaggtaccgttcgtacccggaaagtcccgggtaaaggtacggtacgtaattacccgaagtacccggtaattaccgggnggtaccttnaacccgg

SEQ ID NO: 279144 - DNA, 752 bp, Homo sapiens
  misc_feature: GYAE6OF02GSSNR.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgacaagtccacgccaactaattacttttatactacgttaccaaacaatacgaaaactacttagcttaggtaccagacagacgaccgagacacgcctacgtaggctgcctacgtatttacgcgggactactaccgtaacccgggaacgtcccggggtccctacggacccgtattacgacggtcggaccgtacgggtcggggtaccgtagggactaaggtacttttccgaccgttccctaaccaacctaacttcgaaccggtacgaacggtcccgttaggaccggtacgggtaccgttaagggtaaacgttacggttcgggttacgggtacttttaaggttttttaacgttaagtttaccggttaaaccgtaaaacttaagttttaattttaacgttttaaccttacgtttacgggttacggggttaaccggtttcccggaaccggtaaaccggggtaacttaaacgggttagggtaacttaacggttacggaacggttaaccggtaaaggttcggtacggtacctcggtaaccccg

SEQ ID NO: 279145 - DNA, 712 bp, Homo sapiens
  misc_feature: GYAE6OF02JOV11.19.71.G05.1.454.CMB.1.raw
  modified_base (287)..(287): a, c, t, g, unknown or other
  misc_feature (287)..(287): n is a, c, g, or t
tcagtactctcgtgcacgaccggtgctcgatttagtgtcgtcgcaagagagaggggaggtacgaacaggcaggcaggggcagcaagatggtgttgcagacccaggtcttcatttctctgttgctctggatctctggtgcccacggggacatcgtgagtccacgtctccagactccctcgcgtgtgacttcgtggtccggagcgggcccgacccgactcaaccgtgtcaacggtccagccgaccaatccttttatttacagttacctacaaactcgaaaactacttanaccgttggtaacccgtagacacgtaagacccgaacgttacgagcccgtacctaacggcgttgacctcgtactttacgtagggtacctacgtaccgtaacccgggtaacgttacccggggttacccgtcggtaccgtacgttcgacgtcggacgacggtcgggtacgtacgggacgtacggtacgtttacgtacctcctacctacctactaccacgacgacgccgtacgaccgacggtacgtaggtacgtagtcggtacgtacgtagtttacgttagttacgttacgtaacgtaagttaacgtttaactttaacttacgttacgtacggttaccggttaccggtaccgtaaccgggtaaccggtcccggtacggtaacgttaacgtacgtacgtaacgtaaccgtacggtacggtacgtacgtacg

SEQ ID NO: 279146 - DNA, 606 bp, Homo sapiens
  misc_feature: GYAE6OF02IE8FY.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcaacgtacccctctcgctccacctgtcgccatccgtccggggacagacgtcgctagcgtacgagttgtgcttcggctacgttggcgaggcacgtccccgagtccgagacggtcgtagagtggcgtagggaacgactattattcagtcgtaccgtaacacgtagtaacgtaacaaatttactacgacacctatcgttgtagacggtaacgtcgaacgtcaacgaaacttaacgaaacgtacgacacgtaacgtacgtaaacgtaacccgtacttccgtaccgtcgtacgaacgtcgtacgtaaccgttcgtgtacgtaaccgtcccggaggtaaccgtacgggttatacgtttacgtacgtaggtaggtacggacccgtacccgagtaacgg

SEQ ID NO: 279147 - DNA, 665 bp, Homo sapiens
  misc_feature: GYAE6OF02HDSCR.19.71.G05.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaatcttttanacagttccaacaatagaaaacttacttagccttaggtaccagcagacgaccaggacagcctccgtaggctgctcatttacgngggctacgtaccgtacccgggaacgttccccgggggtccctacggaacccgtagtttcccgaggttcggccgtaagggtccggggtcgttacggggaactaggtacgtttttccaccgttcctaccgaacctatccgaagcctaacgcccgtaggaccgtagggtcctaggaagtacgtggtcggtacttagttttacttagttacgtactaaacttaatttaatttaatttaacgttacttcggttacggtacgttaccggaccgtaacggggtaacctaagggttggtaacttaacgtacgtaaggtaaccgtaaggttggttacggtacctaggtaacccg

SEQ ID NO: 279148 - DNA, 826 bp, Homo sapiens
  misc_feature: GYAE6OF02FJJP3.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggacctggtcgaacgccctcgcacgaccctctcgctcacctgtcgcctactccgtccggggacaggacgtccgcgtacgcgtacgtagttggttcgtcgtttcgggcctacgttcggggttaccgaacggcctaaccggttacccccgaagttccggaacggtaacgggtccgttaagggaacggttcggggacggttacggggaaacggtaacctattaacttttccgaacgtttacggtacccaaaacgtaccgggtttaaacgggaaacttaaaccggtaaaaaactttcgtacggtaaccctaaccgtaacgtttaccgttaagggttacggtaaacgggttaaccgtacgggttaacccacggtaaaacctaaacgttaacccaaaaccggttaaccgaacctaaaccgtacggttaaaccgaaaacgtaaccccgtacggtttacccctacccgttaggaaccttaccgccgtttaaccgacccgttcggttaccggaccgttaaccccgtaccccgggttaaacggaaccggttaccgggttacgtttaaaccggtttactttaccgggtagggttaaccggggaaacccgtaacccgggtacccccgttaggtaaacccggg

SEQ ID NO: 279149 - DNA, 778 bp, Homo sapiens
  misc_feature: GYAE6OF02HUNDC.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccacggggacatcgtgatgacccagtctccagactcccgtggctgtgtctcgtgggcgagcgggaccacatcaacgtcgacaacgtccagacccaataacttctttaacactagttaccaaactaaatagaaaaaccttacttaaggcttagggtaaccagtacgagacgacgaaggacacggtcctaccgtaggctgctactactttacgcgggtactacgtaccgaacccgggtactcccgggtacctcgaccgtaatccagggttcgacgtaggtccgggtacggtaggggaacctaaggttctttaccgacgtttacctacctaccgtaacttcgaacgtccgtaaccgtccgtacggaccgtaacggaccgttaaggaaacggttcgtacgggtacgtaaccggttttaagttttaacgttaaccggtttaacgtaaaccgtaaaacgtttaacgtttaaactttaagttttaacccgttaacggtttaacgggttacggggttaacccggtttaacccgggtaaccggtaaaacggggtaccccggtttaaaagggtccgggttaaagtttaacggtacgtaaccgggtaaccgttaaacgggttcggtaaccggtccgtaacggtaaccccg

SEQ ID NO: 279150 - DNA, 684 bp, Homo sapiens
  misc_feature: GYAE6OF02F6CLS.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgcaacgtccacgaccactaattcttttaactacacgttaccaaactaatacgtaaaaacttacttaagtacctttaggtaaccagacagacgaccaggacacgcctcgtaggctgctactatttacgtggctacgttaccggtaacccggggtaacgtcccggggtaccctaggtacccgtattcgaaggtcggaccgtagggtccgggttacgtaggggaacctaggttaccttttccaaccgttcctaccacctactccgacgccacggtacctggaccgaggtacgtacggaagttacgtgggtacggtactttaacgttttaattacgttacgtaactaaacttaaagtttatttaacttacttacggtttagtaccgggttacgttacgggaaccgtaacgggtaacgtagggtagtaactagtacgaacgtacggtaacgttcggtacggtcacggtaccc

SEQ ID NO: 279151 - DNA, 629 bp, Homo sapiens
  misc_feature: GYAE6OF02IC5VT.19.71.G05.1.454.CMB.1.raw
  modified_base (247)..(247): a, c, t, g, unknown or other
  misc_feature (247)..(247): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
  modified_base (429)..(429): a, c, t, g, unknown or other
  misc_feature (429)..(429): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggacgagccgggaccaccatcaactgacagtccagaccactaattcttttanacagttaccaacaatagaaaacttacttagtacgtcgtaccaagacagaagaccagaccacgccctacgtaggctagtctactatttacgaggccacttacggacccggatcccggggtccacgacgtgtcagcggcncggtcgggtacncgggactagtactttcactctacaccatacanacgacgtcctgcaggtacagtaagtacgtggtacgtacttaacggtttattagttacgactaaacttaattagtttaattaaccttacgttacgtacgggttaccgttaccgggaccgttaaacggggaccttaagggtacgtaattaacgtaccggaaagttacccggtaaggttacggttacggacgtacgtacccgg

SEQ ID NO: 279152 - DNA, 567 bp, Homo sapiens
  misc_feature: GYAE6OF02GM8SF.19.71.G05.1.454.CMB.1.raw
  modified_base (237)..(237): a, c, t, g, unknown or other
  misc_feature (237)..(237): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
  modified_base (435)..(435): a, c, t, g, unknown or other
  misc_feature (435)..(435): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctcagactccctggctgtgtctctgggcgagcgggccacatcaactgcaagtccagccacaattcttttanactacgttaccaacaatagaaaactacttagctttggaccagcagagaccaggtacacgtcctcgtaggctgactctatttacgtgggaccacttccggtaccccgggtaagtcccggggtacctgaccgtaattcgagtgcgagcgggtnaggacagtcttcactctcacntacagcacgctagcgtacgctagaanagtgtcggacttagtttacttgttacgactaaactaattatttaatacttacgttcgggtagtaccgttacgaccgaagggtactaagggttanaacgttanaccgaagtacgtaagttggcgtactgaccc

SEQ ID NO: 279153 - DNA, 735 bp, Homo sapiens
  misc_feature: GYAE6OF02IZ8WE.19.71.G05.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaacgtccagccacaattcttttaanactagttccaacaatagaaaactacttagcttaggtaccagcagacgaccaggacacgcctcgtaggctgctctactttacgngggactacgttccgtaacccgggaacgtcccgggggtccctacggaacccgtacttaccgaaggttcggacgtaacgggtccggggtctacggggaactaggttaccttttcgaccgttccgtaccgtaccctaacgtccgaacgtccgtaacgtcccgttacggaccgtacgggttaccgtaggtaaacggtacgttacggtacgggtacttaacggttttaactttacgttacggttaacctaaacgttaagtttaacttttaacgttaacgtttaccgtttacgggttacgggtaccgtttaccgggaacccggtaacgggtaacccgttaacgggtacggtaacgttaacgtaccggtaacggtaaccggttaaaccggtggttaccggtaccgttacgtaacccg

SEQ ID NO: 279154 - DNA, 615 bp, Homo sapiens
  misc_feature: GYAE6OF02GZIRV.19.71.G05.1.454.CMB.1.raw
  modified_base (247)..(247): a, c, t, g, unknown or other
  misc_feature (247)..(247): n is a, c, g, or t
  modified_base (383)..(383): a, c, t, g, unknown or other
  misc_feature (383)..(383): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctctgggcgaggcgggccaccatcaactgacaacgtccagcccacaacttcttttaanacacgttaccaaacaatagaaaactcttagcttaggtaccagacagagaccaggacacgcctcctaggctgctctactttacgtggcactccgtacccgggtagtcccggggtccctagaccgtattcagtcggcncgcgggtctgggactagtactttcactctaccacagtcagcacgcctgcgacggctaggtaacgtgtggtacgtctaaggttttacttagttacgtacaaactaatttactttaatttacttacgttcgtaggttaccgtttccgggaaccgtaaagggtccggtaaagggttcggtaaacgttacgtcggtaaacggacgttaaccgttcgggtacggttctcgtaacccg

SEQ ID NO: 279155 - DNA, 711 bp, Homo sapiens
  misc_feature: GYAE6OF02HSZ35.19.71.G05.1.454.CMB.1.raw
  modified_base (255)..(255): a, c, t, g, unknown or other
  misc_feature (255)..(255): n is a, c, g, or t
  modified_base (348)..(348): a, c, t, g, unknown or other
  misc_feature (348)..(348): n is a, c, g, or t
  modified_base (692)..(692): a, c, t, g, unknown or other
  misc_feature (692)..(692): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatcgacccagtcctccagacctcctggctgtgtctcgtgggcgaggccgggcctaccgatacgaactcgactaagtccagacacattctttanactagttaccaaacaatagaaaactacttagcttaggtaccagtcaaggacgacctaggacacgtcctcgtaggctcgactctagtttaccgngggtacctagtacctacccggggtaaacgttcccggggttcccaggtaccccgtaagtttcccgaaggtcggaccgtaacgggtccggggttacgttacgggggactaacggtacgttttccgaacgttaccgtcctaacccgtaagttccgaaagcctaacgggccgttaccgaccggtacggtccgttaagggaaacggtacgttaacgggtccggttaattaccggttttaaagtttacgttcgtaacgtaacctaaagtactttaattaacgttacgttacgtcgggttaaccggttaccggaaccgtaacgggacgtaaggttacggataccggttaanacggttacgaacggttcgg

SEQ ID NO: 279156 - DNA, 701 bp, Homo sapiens
  misc_feature: GYAE6OF02I2HWF.19.71.G05.1.454.CMB.1.raw
  modified_base (269)..(269): a, c, t, g, unknown or other
  misc_feature (269)..(269): n is a, c, g, or t
  modified_base (368)..(368): a, c, t, g, unknown or other
  misc_feature (368)..(368): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccgacggggacatcgtgatcgacccagtctccagactcctggctgtcgtcctgtcgggcgacggccgggcccaccagtaccaaactcggaccaagttcccagccctaactaacttcttttaanactacgttacccaaaactaataacgtaaaaccttacttacgtcgttacggtaaccagctaagacgaccgaggacacgcctctaggctgctctattacgnggcacgtccgtaaccggtacgtcccggggtcctaggaccgtattcgaggtcgcgacgggtccgggtacgtacggactacgtacgtttacccacttccgtccaacctagtcaacgtccgacgtccgtagacgtacggtactaaggaacgttagtcgggtacgtacgtttagttttaacttacgtttaacgtacctaaaacgttatttaaagttaacgttttacttaccggtttcggtaacgggttaccggttaccgggaacccggtaaacggggttaccgaaggttacgggtaactttaacgaccggtaacgggttaaccgtacggttacgggg

SEQ ID NO: 279157 - DNA, 763 bp, Homo sapiens
  misc_feature: GYAE6OF02HXNQ1.19.71.G05.1.454.CMB.1.raw
  modified_base (268)..(268): a, c, t, g, unknown or other
  misc_feature (268)..(268): n is a, c, g, or t
  modified_base (381)..(381): a, c, t, g, unknown or other
  misc_feature (381)..(381): n is a, c, g, or t
  modified_base (565)..(565): a, c, t, g, unknown or other
  misc_feature (565)..(565): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtcgcccgacggggacatcgttatgacccagtctccagacctccctggctgtcgtctcgtgggcgaggccgggccacactcaactgacaacgtccacgccaactaacttcttttanactacgttaccaaataatacgtaaaaccttacttacgcgttcggaaccagacagacgaccaggaccaacgtccccgtacgtacggtccgtacgtcgttactaagttttacggngggtacctacgttaccccggttaaccccgggggtacggttaccccggggttaccccgtacgtaacccgtagtttacccgtagggttcgggaccgtacggggtcggggttacggagggtaacccgtacggtttacttttacccgaccttcctaaccgaacctagtaccgacgtaccgccgttacncggtaaccgacgtactaacgggaagtaccgttggtaacgttacgttaacgtttaagtttacgttacgttaaaccaaaattacttttaagttttaacgtttagttaacccggttgggttaccgggtttaaccgggttaacccgtaaccgggttaaacgggaaccgttaagggtacgttaacgtagtacgaaccggtaag

SEQ ID NO: 279158 - DNA, 608 bp, Homo sapiens
  misc_feature: GYAE6OF02H27PL.19.71.G05.1.454.CMB.1.raw
  modified_base (237)..(237): a, c, t, g, unknown or other
  misc_feature (237)..(237): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcagtccagccactaatcttttanacacgttaccaactaatagaaaactacttagtcttaggtaccagcaggagaccaggacacgcctctaggctgctctatttacgngggacactccgtaacccgggacgtcccggggtacctgaccgtattcgaggtcggcgaggtcgggtctgggacagtatttcgactcctaccaccatacacgcacgtcctgacgtggtactaggaagtacgtggtacgtacgttagttttattagttacgtactaaacttaatttattatttaacgttcgttacggtaggtaccgttccgggaccgtaacggggtaccgtaagggttacgaacttacgtacgtacggaacgtaccgttagggtaccggacttaggaccc

SEQ ID NO: 279159 - DNA, 700 bp, Homo sapiens
  misc_feature: GYAE6OF02J1KWM.19.71.G05.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagacctccctggctgtgtctcgtgggcgagcggcctaccatcaactgaccagtccagccacaattctttanacacgttccaanaaatacgaaaactacttagccttggtaccagaccagagacccgaggacacgacctccgagggtctcgtctactaactttacgcgggtacacttaccgtacccgggggtaacgttcccgggggtccctacggtaccggtatttccgaaggggtcgacgacggtcggggttcgtacgggacctaggttaaccttttcccaacttccgtacgtaccgtactaccgacgcgacggtccgtacgacgtacgggtctaacggtaacgtagttacggtcgtaacgtttaaggttttaacttttaggttaacgtacgtaaacttaagttaacttttaacttaacgttttacggttacgttacggggttaccgttacggaaacggtaaccgggtaacggtaggtaacgtaactacgtagaaccgtaagtaaccgtggtacgtccgtactaaccg

SEQ ID NO: 279160 - DNA, 678 bp, Homo sapiens
  misc_feature: GYAE6OF02FMUL5.19.71.G05.1.454.CMB.1.raw
  modified_base (242)..(242): a, c, t, g, unknown or other
  misc_feature (242)..(242): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatccaactcgcaacgtccagccacatcttttaanacagttccaacaatacgaaaacttcttagcttaggtaccagcagacgaccaggacacgccctacgtaggctgtctactacgtttacgtgggctacgtaccgtacccgggtaactcccggggttccctacggaccgtattccggaggtacgggcgtacggtcgggttcgtcgggtacgtacgtacgtttcaccgtctaccgacctagtaccacgtcacggtcctacgacgacggtacctaggaacgtgttcggtacgtcttaaggttttacttacgttaggtactaaacgtaaactttatttaaccgttaacttacggtttccgacggggttaccgtttacgggaacccggttaaacggggaccgttaacggggttacgtaacgttacgtaacgtaacggtaaccggtagtacgggttcggtacgtaccgtaacccg

SEQ ID NO: 279161 - DNA, 634 bp, Homo sapiens
  misc_feature: GYAE6OF02G9PT7.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttatacagttccaacaatagaaaactacttagcttggtacccagcaagacgaaccgaggacacgccctaccgtaggctgctctatttactgggctactcgtacccgggtaacgtcccggggtccctgaccgtattcgagtggcagggtcgggtcgtacgggactaggtatttccaaccgtctacctacccaagttccaacgccacgtccctgccgaggcttagaagacgttggtggtacttaggttttaatttacgtttagtaaccttaaacgtaaattaaactttaacttacttacgtttacggttaccggtaacggtttaccggtaacccgaaaggggtaaccgaaaggggttcggtaacgttactacggtaacggtaccgaagttcggg

SEQ ID NO: 279162 - DNA, 718 bp, Homo sapiens
  misc_feature: GYAE6OF02IGBYK.19.71.G05.1.454.CMB.1.raw
  modified_base (141)..(141): a, c, t, g, unknown or other
  misc_feature (141)..(141): n is a, c, g, or t
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (329)..(329): a, c, t, g, unknown or other
  misc_feature (329)..(329): n is a, c, g, or t
  modified_base (477)..(477): a, c, t, g, unknown or other
  misc_feature (477)..(477): n is a, c, g, or t
tcagtactctcgtgcacgaccggtgctcgatttagtgtcgtcgcaagagagagggggaggtacaacaggcaggcaggggcagcgaagatggtgttgcgagacccaggtcttcattttctctgttgctctggatctctggtncccacggggacatcgtgatgacccagtctccagactccctggctgtgtctntgggcagcggccaccatcaactgcaagtccagccaanaattcttttanacagttaccaaactaatagtaaaacttacttagcttacggtaccagcaagagaccaggtcaacgccttcctaggcttgctcatttacgngggactactaccgtaccgggaactcccggggtacctggaccctattcgagtcggccagggtccgggtactggggacctaggtattttccgactccgtacctaccgtacttcgaagtcgaccgtctagacgacggtacgtaggtaaggngttacggtaggtaccgttaagttttacgttaacgttacggttacctaaacgttaaacttttaactttaacgtttaaacgttttaaaccgtttacgtttaacggggttacccgtttaaccgggtaacccggttaaacgggtaaaccccggttaaggggtttaacccgggtaagtttaactaccggttaaacggtaaccgggttaaaccgttcgggtttaacggtccggttcgtaaaccccgg

SEQ ID NO: 279163 - DNA, 574 bp, Homo sapiens
  misc_feature: GYAE6OF02GZXYU.19.71.G05.1.454.CMB.1.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccacatcaactgcaagtccagccacaattctttanactacgttccaactaatacgaaaaactacttagcttaggaccagcagacgaccaggacagtcctccgtaggctgctactatttacgngggctactaccgtacccgggaatcccggggtcctgaaccgtatcgagtgcaggcgggtcgtggacagtactttcactcacgactancgancgacgcctgacgaggtctagaagtagtgagggtactagtttacttgtacgtacaaatattattagtttaattacttcggtagtaccggttacggacgtaaacgggtcctaaagggtgtaactagttcgaaacgtacggaagttggacgtacgtagaaccg

SEQ ID NO: 279164 - DNA, 537 bp, Homo sapiens
  misc_feature: GYAE6OF02GU42R.19.71.G05.1.454.CMB.1.raw
  modified_base (239)..(239): a, c, t, g, unknown or other
  misc_feature (239)..(239): n is a, c, g, or t
  modified_base (388)..(388): a, c, t, g, unknown or other
  misc_feature (388)..(388): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtcnccatctccggggacagagtcgctagcgacagtgttgcttggcacgtggtcaggcacgtccccatcgagaggtctagagtggctggaagacatatttcatgtaccaacacgtggaatacaattatcgacacatctgttgagagtcgtacngacactacaacgtacgacgactagacgaacgaacctacgttaccgtcccgtgactacgcctacgtacctcgtacgtacgaccgtcccgaaggaccgtacgggtagttacgttagtttacgtgtacggtaacgacggtaccccagtaacg

SEQ ID NO: 279165 - DNA, 593 bp, Homo sapiens
  misc_feature: GYAE6OF02F8KQJ.19.71.G05.1.454.CMB.1.raw
  modified_base (347)..(347): a, c, t, g, unknown or other
  misc_feature (347)..(347): n is a, c, g, or t
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgacccctctcgctcacctgtgccatccgtccgggggacaggacgtcgctagcgacagtgtcgcttggcacgtggtcaggcacgtccccatcgagaggtctagagtggcgtaggggaaggactatatttnagtcgtacccaacgaacggtaggaaacttaactaaatttagcgtaccaacctatcttaggtagtaagagtcgacgtacgaactaataccgaacgtacgaacactaatacgaaacgtaacctacgttcctaccgtcgccagtctacgaccttcgtacgtacgtaccgtcccggaaggaccgtacggttagtaacgttaacgttacgttaggtacgggaaccggacccggtacccctaagtacgtacg

SEQ ID NO: 279166 - DNA, 663 bp, Homo sapiens
  misc_feature: GYAE6OF02FUGZF.19.71.G05.1.454.CMB.1.raw
  modified_base (207)..(207): a, c, t, g, unknown or other
  misc_feature (207)..(207): n is a, c, g, or t
tcagtactctcgtgcacgaccggtgctcgatttagtgtcgtcgcaagagagaggggggagagtctgctgaattctggctgaccagggcagtcaccagagctccagacaatgtctgtctccttctcttcttcctgcccgtgctgggccctcccacaaggtcgtcctgtcacaagtacagctgcagcagtcaggtccaggactgggtanaacgcccctcgcaacgaccctctcgctcaccttgtcgccatccgtaccggggacaggtagtcgctaagacgactagtgttcgtcgttggactacgtcgggtcacggctacgtccccagtcggacgaggtacctaggtgtggtacgtaggggaacgactattacgtttcgaacgtcgttaccaaacgtacggtaggtaaaactaacgtaaacttatacgcctaaccgtacttcgtgtaggaagtacgtacgaacgtacgaacaaacgtacgtaaacggtaacgaaccaacgtaacgtaccgaaacgtaacccgtacgttacctcccgttacgtacctacgtcctacgtaacctttcgtacgtaccgtaccgttacccggacgggtaacggtacgggttaacgttatacgttacggtaggtaccggaaacggtacccgtacccgttaactaggtaacc

SEQ ID NO: 279167 - DNA, 643 bp, Homo sapiens
  misc_feature: GYAE6OF02F3GYA.19.71.G05.1.454.CMB.1.raw
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (384)..(384): a, c, t, g, unknown or other
  misc_feature (384)..(384): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatgacccagtctccagactccctgctgtgtctctgggcgaggcggccacatcaactgcaacgtccagccaacaacttcttttanacagttccaaacaatagaaaactacttagcttagtaccagcaagagaccaggacagcctcctaggctgctactactttacgnggctatccgtaacccggaagtcccggggtccctaggacccgtattcgagtggcaggcggtntgggacagtactttcactctcaccatcagacagcctagacgacggtcctaggaagtacgttggaggtccttaaaggtttttatttaagtttcgtaactaaaccgttaattaagttttaattaacgtttaaccgtttcgggttacgggttaacccgtttccgggacccgttaaagggtaaacccgtaagggtttaacgggtaattaacgttacgaacgggtaaccgtaacggttacgggtcggacccgttaggaaccccg

SEQ ID NO: 279168 - DNA, 712 bp, Homo sapiens
  misc_feature: GYAE6OF02GPYCB.19.71.G05.1.454.CMB.1.raw
  modified_base (204)..(204): a, c, t, g, unknown or other
  misc_feature (204)..(204): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcagtccaggactggtnaagccctgcagacccctctcgctcacctgtcgccatccgtccggggacagagtcgctagcgacagtgttgcttggcacgtggtcaggcacggtccccagtccggagtcggtcgtagtaggtcggcggtagggaacggactattaacgtttcaacgttcgtaccgtaaacgtaccggttaagggtaaacttaaccgtaaaagttttaacgtcggaccctaaacccgtatttccgttacggttaaggaacggttaacgttacccgggtaaccttacggaaaccgttaaacttaccggtaaaacgttaccgaaacctaccggtaaagttaacccgggtaaacgtaaacccgtaaccggtttaccctcccggttagaccgtaacgtaccgtaccggtaacccttcgtacgttaccgtacccgtacccgggtaacgggtaaccggtaacgggttcgttaagttacgttacgttacgggtaacggtaaccgtaccggtaccccgagttaaccgg

SEQ ID NO: 279169 - DNA, 829 bp, Homo sapiens
  misc_feature: GYAE6OF02G6QH7.19.71.G05.1.454.CMB.1.raw
  modified_base (231)..(231): a, c, t, g, unknown or other
  misc_feature (231)..(231): n is a, c, g, or t
  modified_base (563)..(563): a, c, t, g, unknown or other
  misc_feature (563)..(563): n is a, c, g, or t
tcagtactctcgtgcacgaccggtgctcgatttagtgtcgtcgcaagagagaggggggaggtacgaacaggcaggcgaggggcagcaagatggtgttgcagacccaggtcttcatttctcttgttgctctggatctctggtgcccacgggacatcgtgatcgacccagtctccagacctccctggcctgtcgtctcgtggcgagcgggccaccatcaacgtgcaagtccanacctactaaattcttttaacgtactacgttaccaaacctaatacgtaaaaacttaacgttaggactttaggtaccagacaaggaccgaacctaggaccaacgcccttaccgaagtctgacttacagtttaccgtggactacgtcccgtaaaccgggtacgtacccggggtacccctggaaccgtacgtttccgaaggttcggaccgaaggcccggggtttacgttaacggggaacctaacggttaaccttttcctaccttaccgttaccaccaacgtaccgtacgcgaaccgttccggacacggtaacggtcccttaagaaaggttaaccgnggttacggtacccgtttaaggttttttaacccttaggttttaccggttaaccgtaaaaccgttaaaatttaagtttttaaactttaaccgggtttttaaaccctgggggtttacccggtttaaccggttacccgggtaccccgggtaaaccggttaaaaccggggtaacccgggttaggggtttaaaaacctccggttaaacgttaaccccggggtaaccggttaaacggtttacgggtttaccggtaccggttaccggaaccccg

SEQ ID NO: 279170 - DNA, 595 bp, Homo sapiens
  misc_feature: GYAE6OF02F648Y.19.71.G05.1.454.CMB.1.raw
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtcctccagacctccctggctgtgtctctgggcgagccgggccaccgatcaactgcaagtccagccacaattcttttanacacgttaccaacaatagaaaactacttagcttaggtaccagcagacgaccaggacagcctccgtaggctgctctaatttacgngggacatccgtaccggacgtcccggggtcctgaccgtattccgaggtgcgaggcggtcgtcggacagtctttcacgtcctacacctatcacgctacgcctgacagggtctagggactagtaggtgacttagtttacttagttacgtactaaacgtattaatttattaattacttacggtacggtaacgtttccgggaacgtaacggggaccgtaagggttggtaattacgactaacggacggtaacgttggtcggtacgtacgtacc

SEQ ID NO: 279171 - DNA, 729 bp, Homo sapiens
  misc_feature: GYAE6OF02JNX85.19.71.G05.1.454.CMB.1.raw
  modified_base (174)..(174): a, c, t, g, unknown or other
  misc_feature (174)..(174): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacngctgcagcagtcacggtccaggcgtggtcgaacgccctacgcaccgaccctcgtccgccttcctaccgtcgctaccatccggtaccggggaacngtaacggttccgactacggaccgtaacgnggttggttcgtcgttcggaccgtacggttacgggtccgacggtccgacccgtccccgtacgtacggaggtacggttcgtaacggngtcggtcggtagggaacgtacgagtttacgttaccgagttcgaccgtaaacgtcgttaagtaactaataaacgtttacacgaacctaccgtacttacgtacgggttagaacggttacgtacgtaacgtacgtaacaacgttacgttaaacgaacgacctacgaaacgtaccgaaacggtaaccttaccgttaccctaccgtactaaccgtaccggtacttacccgtaccgttacggtaccgtaccgtacccgtaccggaaccggtacggtaacggttaccgttaagttaacccgttacggttacggaccggtaacggtaccccgtaacccggttactaacggtaccg

SEQ ID NO: 279172 - DNA, 650 bp, Homo sapiens
  misc_feature: GYAE6OF02F0NXE.19.71.G05.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccgacgggacatcgtgatgacccagtctccagacctccctggctgtgtctcgtgggcgagccgggccacgatacaacgtcgactaagtccagccaactaattcttttanacacgttaccaaacaatacgaaaactcttagcttggtaccagcagacacaggacagcctcgtaggctgccttacgtacttttacgcggtactacgtaccggtaacccgggaacgttcccggggtaccctacggaaccctattcgaggtacgcgaacggtccgggtctacgggactacgtactttccgactctaccgactactcacgtacacgctgcaggcctagaagtatgtacgtagttagtttacttagttacgtaaccgtaaataaacgtttaattaactttaacgttaccgtttacgtacgggttaacccggttaaccggaaccgtaaacggggtacccgttaaagggtcggtaacttaccgtaacggtaacggaacccgtaagttccggg

SEQ ID NO: 279173 - DNA, 627 bp, Homo sapiens
  misc_feature: GYAE6OF02HHLJ5.19.71.G05.1.454.CMB.1.raw
  modified_base (255)..(255): a, c, t, g, unknown or other
  misc_feature (255)..(255): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaacgtccagccactaattcttttaatacagttaccaanaatagaaaactacttagcttggtaccagcagagaccaggatagcctctaggctgctcatttacnggctactcgtaccgggaatccggggtcctgaccgattcaggtcgcaggtcgggtcgtagggacagtactttcgaccgtactacgacctagtaccacgacacgaccctggaccgtagggcctaaggaaggtagttggcggtacttaaggttttacttacgttacgtacctaaagttaaactttaagttaatttagttaccgttacggttacggttaccggttccggaaccggttaaacggggaacctaagggtacgtaagttacgtacgtaacggtaaccgtaaggttcggtacggtactaggtacccg

SEQ ID NO: 279174 - DNA, 608 bp, Homo sapiens
  misc_feature: GYAE6OF02FNHUC.19.71.G05.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcaagtccagccacaattcttttanacagttccaaacaatagaaaactacttagcttaggtaccagcagacgaccaggacacgcctcctaggctgctctatttacgnggcactccgtaacccgggacgtcccggggtccctgaccgtattcgagtcggcgaggcgggtcgtgggaccaggtactttcactctacacatcagcacgtcctgcgaggctagaagtgtacggtgtacttagtttacttagttcgtaactaaactaattaatttaaactttattaccgtttcgtacgggttaccggttacggaccggtaacgggtaacccgtaagggttacggtaagttaacgtacgtaacggtaaccggtaacgttggtacggtcgtacgtaacccg

SEQ ID NO: 279175 - DNA, 765 bp, Homo sapiens
  misc_feature: GYAE6OF02FSR9E.19.71.G05.1.454.CMB.1.raw
  modified_base (190)..(190): a, c, t, g, unknown or other
  misc_feature (190)..(190): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagtactctcgtgcacgaccggtgctcgatttagtgtcgtcgcaagagagagggggagggtacgaacaggcaggcaggggcgagcaagatggtgttgcagacccaggtcttcatttctctgttgctctggatctctggtgcccgacggggacatcgtgatgacccagtctccagacctccctggctgtntctctggcgagcgggccaccatcaactgacaagtccagccanaattctttanacagttaccaacaatagaaactacttaagcgtttacggtaccagtaccaggtaacgacccgaaggaaccgacgtccccgtaccgttaacggccttcgggcctaccgttactttaccgtaggggcctaacgtaccggtaacccgggtaaccgttccccgggggtcccttacgaccgttacgtttccgaagggttcggacgtaacggccggggttacgtcggggtaacgtacggttaactttacccgtacttaccgttaccgaacccgttacacccgtaggacgttacccgccggttacgtaccggagggtacccttagggtaaagcggttacgtacgggtacgtttaaggttttacgtttaatacggttaccaaaccttaaagtttaacttttaacgttatttaaacccggtttgggtaaccgttacggttaccggttacccggaacgggttaacgtaacggggtacgttaagaaccgtttacgaacggtaccgttaaccggtaacggtgtcccggttagaccc

SEQ ID NO: 279176 - DNA, 645 bp, Homo sapiens
  misc_feature: GYAE6OF02FSUML.19.71.G05.1.454.CMB.1.raw
  modified_base (241)..(241): a, c, t, g, unknown or other
  misc_feature (241)..(241): n is a, c, g, or t
  modified_base (330)..(330): a, c, t, g, unknown or other
  misc_feature (330)..(330): n is a, c, g, or t
  modified_base (387)..(387): a, c, t, g, unknown or other
  misc_feature (387)..(387): n is a, c, g, or t
  modified_base (423)..(423): a, c, t, g, unknown or other
  misc_feature (423)..(423): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggccaccatcaactgcaagtcccagccacaattcttttanacagttaccaaacaatagaaaactacttaagcttaggtaccagcaaggacgaccaggacacgcctacctaggctgctacgtatttacgnggcatccgtaaccggagtcccgggtcctagaccgtatcgagtcggcgaggcgggtcncgggactagtactttcacttcacacctagtccagcncgtaccgtcgagacggtcttaggaaagtcgttcggtaggtaccttaggtttttactttacgttactacgtaaacttaagtttaacttttactttaaattacggtttaccgttaggttaccggtttacccgaaccggtaagggtaaacccgtaagggttagtaacgttaacgtaaccggaacggtaaccggttaaacggttgtacggtaccgtacggtaaccc

SEQ ID NO: 279177 - DNA, 720 bp, Homo sapiens
  misc_feature: GYAE6OF02H6CM8.19.71.G05.1.454.CMB.1.raw
  modified_base (243)..(243): a, c, t, g, unknown or other
  misc_feature (243)..(243): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccacgccaacaattcttttanactagttaccaacaattgaaaaacctcttagacttaggacctagcagagaacccaggacacgcctaccgtaggcctgctctatttacgtcggctagtccgtacccgggtaacgtcccggggtccctacggaccgtcttacaggtcggcgaggcggggttctggggtaacctaaggtacttttaccgacgtttcctacctaaccgtattaccgaacgtaccacggtaccctcggcggtaaccggtcttaacgggaaagtacgttgggtacgggtacttaaagtttttactttaagttacgttaacctaaaaccttaaatttaacgttttaaattttaaccgtaaccgttttcgggttacgggtttaaccggttccgggaaccggttaaacgggggtaacccttaagggttaccggaaatttacggtaccgaagggttaacccggtaaacgtttggggaaccgttccgtacgtaacccg

SEQ ID NO: 279178 - DNA, 718 bp, Homo sapiens
  misc_feature: GYAE6OF02I1B8R.19.71.G05.1.454.CMB.1.raw
  modified_base (187)..(187): a, c, t, g, unknown or other
  misc_feature (187)..(187): n is a, c, g, or t
  modified_base (246)..(246): a, c, t, g, unknown or other
  misc_feature (246)..(246): n is a, c, g, or t
  modified_base (711)..(711): a, c, t, g, unknown or other
  misc_feature (711)..(711): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagactccgtgctgtntctcgtgggcgaggcggccacatcaactgacaacgtccagcccaactaattcttttaanactacgttacccaaactaataacgtaaaaccttcttaagtccgtttacggtaaccaggactaaggaacgaacccgtaacggaaccaccggtacccttaccggtaggtcctaggtccctactacgttttaacggcgggtacctaacgtaccccggtaacccggggtaacgttccccgggggttacccctaggtaacccgtattaccgacgggtcggaccgtacggggtcgggtacgtacgggaaccgtagttactttaccgacgttccctaccgacctactccgagcctcggtccaggtccgaggtcgtaggaacgtgtcggtacgtacttaggtttaacttatcgtaaactaacgttaatttaacgttatttactacggtttggaccggttacgttaccgggtaacgtaacgggtaacggtaaggtaggtaatacgtaacgtacgtacgtaacgtggtacgtcgntaacccg

SEQ ID NO: 279179 - DNA, 824 bp, Homo sapiens
  misc_feature: GYAE6OF02FIMCQ.19.71.G05.1.454.CMB.1.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtcctccagacctccctggctgtcgtctcgtgggcgagcgggccaccatccaacgtgacaaggtccacgccaactaattcttttaanacgtacgttaccaaanaatacgaaaacttacttagcttaggtaccagcaagagaaccgaggacacgcctacgtacggctgactctaactttacgtgggcacgttccgtaacccggggtaacgttccccgggggtaccctacgggacccgtagttacgagggtcggaccggtagggtccggggttcgtacggggaccgtaaggttaccttttacgaaccgttcctaaccgacctaacgtctaacggacctacggtacccgtacggacccggtaacgggtaccttaagggaaacgggttacgttacgggtacgggttaaccgtttaaagggttttttaacgtttaaccggttaacggttaaacccgttaaaaacgtttaacgttttaacgttttttaaacgtttaaacgtttaccggttttaccgggtttaccgggggttaacccgggtttttaccggggaacccggttaaacgggggtaaaccccgttaaggggtttacggaaaccgttttaccgaacggttaaacggtaaccgggttaaacgttcggggtacggtaccggttacggtaccccg

SEQ ID NO: 279180 - DNA, 720 bp, Homo sapiens
  misc_feature: GYAE6OF02HZZHX.19.71.G05.1.454.CMB.1.raw
  modified_base (201)..(201): a, c, t, g, unknown or other
  misc_feature (201)..(201): n is a, c, g, or t
  modified_base (530)..(530): a, c, t, g, unknown or other
  misc_feature (530)..(530): n is a, c, g, or t
  modified_base (563)..(563): a, c, t, g, unknown or other
  misc_feature (563)..(563): n is a, c, g, or t
  modified_base (615)..(615): a, c, t, g, unknown or other
  misc_feature (615)..(615): n is a, c, g, or t
  modified_base (636)..(636): a, c, t, g, unknown or other
  misc_feature (636)..(636): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacgggacatcgtgatcgacccagtctccagacctcccgtggctgtgtctcgtgggcgngccgggccaccactacaactcgacaacgtccagtaccaactactttctttatactacgttaccaaactaacgtaacgtaaaaccttacttacgtacttacggtaaccacgacgacggtaagaaccgaaggacctacggtacctccgtacggctctacgtcttaacgtttaccgaggactacgtacccggggtaacccggaacggttccccgggtccgtaccggtaccgtaagttcgcggtcggtccgacggggtccggcgttacggaacgttacgtacttttaccaccgttcctaaccgaccgtcgtaccgaacgaccgtcgtaccggntacggacgtgaaccgtaagcgtcggttaacggnttagtttattaccggtaagtactaactaagtttactttagtacctttaggtnttaacgggtacccgggtttanaacccgggtaaggtccggttaaagggttctaagtaccgttaacggaagttacccggttacgttacggggtatcccgtaagcccc

SEQ ID NO: 279181 - DNA, 696 bp, Homo sapiens
  misc_feature: GYAE6OF02F7L1A.19.71.G05.1.454.CMB.1.raw
  modified_base (245)..(245): a, c, t, g, unknown or other
  misc_feature (245)..(245): n is a, c, g, or t
  modified_base (553)..(553): a, c, t, g, unknown or other
  misc_feature (553)..(553): n is a, c, g, or t
  modified_base (645)..(645): a, c, t, g, unknown or other
  misc_feature (645)..(645): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtggcgagcgggccaccagtaccaactgactaagtccacgccaacaattcttttanacctacgttaccaacaatacgaaaactcttagctttaggtaaccagacaaggaccgacacggacacgccttacagggtctaggccttacgtaactttacgtaggggtcctaattaccggttaccccgggaagttccccggggtaccctacgtaccggtaattccgtaagggttccggcgtaacgggtacggggtttccggtacggtaaccgaacggttactttttaccgaaaccgtttcctacccggtaacctacgttcacggtaccgacgtacccgtaagtccgagggttccaagtacgagttacgngtaccgtagttttatacgtcgttacaacttaagtactttacttaactacgttcgtaggtaccgttacggaacgttaacgggacttaacgggntaacgttacaagtaccggtaacgtaacgttacggtacggtcttacgaaccc

SEQ ID NO: 279182 - DNA, 624 bp, Homo sapiens
  misc_feature: GYAE6OF02HCFTF.19.71.G05.1.454.CMB.1.raw
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctctggtgcccacggggacatcgtgatgacccagtctccagacctccctggctgtgtctctgggcgagcgggccaccatcaacgtgacaagtccagccactaattcttttatacacgttaccaaacaatacgtaaaacttacttagctttcggtaccagcagagaccaggacagcctcctaggctgctctatttacgtgggctatcccgtaacccggggattcccggggtccctgacccgtattccgaggtcggcacggtcggggtcgtcgggactaggtacttttcgactcgtacaccctatccagcagccctgccgaggctaggaagtgtggtcgtcttagtttattatttcgtaactaaacgtaatttactttagttaacttaccgttagggtacgggtaccgtttccgggaccggtaacgggtaaccggtaagggttacgtacttacgtaccggaaggtaaccgtaacgttggtccggactcggacc

SEQ ID NO: 279183 - DNA, 812 bp, Homo sapiens
  misc_feature: GYAE6OF02J0U58.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtcgtctcgtgggcgaggccgggccaccatcaactgacaacgtccacgccactaacttcttttactacctacgttaccaaactaagtaacgtaaaaccttacttagtacgtttacgggtaacccaaggccaaggaaccgtaaccgaacgggacctacggtaccccttaccgtaacgggccttacggtaccttacgtaacgttttacggcgggtacctaacgttacccggtaacccggggtaacggttcccggggtaccctaggtaacccgttattccggtagggttacggcgtaacgggtccggggtacgtacggggtaataacggttactttacctaccgttctacccgtaacctcgtaacgacgtaccgtacgtccgttacggacgacgggtcgtaacggaaggtacgttcgggtcggttaactttacggtttttaagttactacggtaaacctaaattaatttacgttttaagttaaccgtttacggttaccgggttacggttaaccggttacccgggaacggtaaaccgggttaaccggttaagggttacggtaactttaacggtaaccggtaagggtaaccgttaaccgggttacgggttccggtaacgtaccgtaaacccgg

SEQ ID NO: 279184 - DNA, 608 bp, Homo sapiens
  misc_feature: GYAE6OF02HLGO8.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaattcttttatacagttaccaacaatagaaaactacttagcttaggtaccagacagagaacccaggacacgccctccgtaggctgcctcatttactgggacatccgtaacccgggaatccggggtccctcgaccgattcgagtggcgaggtcgggtcgtagggacagtactttcactctcaccatcacgccagcctagcacgctagagtagtggtagactagttttattattagtactaaacgtaattaactttaattaacgtttacttacggttagggtaaccgtttccgggaaccgtaaaccggggtaacccgtaaggggttacggtaataacgttacggaacgtaaccggtaacgtggtacggtctacgtaacccg

SEQ ID NO: 279185 - DNA, 800 bp, Homo sapiens
  misc_feature: GYAE6OF02IXZL9.19.71.G05.1.454.CMB.1.raw
  modified_base (248)..(248): a, c, t, g, unknown or other
  misc_feature (248)..(248): n is a, c, g, or t
  modified_base (393)..(393): a, c, t, g, unknown or other
  misc_feature (393)..(393): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacgggacatcgtgatgacccagtctccagactccctgctgtgtctcgtgggacgagcgggccacgactacgactcgacaagtccagccactaacttacgttttanactacgttaccaaactaagttacgaaaaacttaccgttaacggtcctttacggtaacccagaccgaagtaaccggaaccgaacgggtaacaaccggtccccttaaccggtagggtccgtcgtaccttacgtaacgtttttaacgnggggttaccctaggtaaccccgggttaacccggggtaaaccgttccccggggggttaccctaacggtacccgttaagttacccggtaaggttccggggacgttaacgggggccggggttaccggttaccggggaacgttaacggttaccgttttaccgaccttacccggtacaaccctagtaccgacgtacgtaaccgtcgtacgacggacgtacggtaagagtacgtacggtacgtacgttattttacgttacgttagtaactaaacttatttaagttaaactttagttaccgttacggtacggttaccggttaccggaaccggtaacgggtaaaccggttaacgggttagtaaacggttccgaagtaacggtaccgttaaggtcggttaacgtcgtaacgaaccc

SEQ ID NO: 279186 - DNA, 709 bp, Homo sapiens
  misc_feature: GYAE6OF02J0P7B.19.71.G05.1.454.CMB.1.raw
  modified_base (190)..(190): a, c, t, g, unknown or other
  misc_feature (190)..(190): n is a, c, g, or t
  modified_base (317)..(317): a, c, t, g, unknown or other
  misc_feature (317)..(317): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtntctcgtggcgaggcggccacatcatcgacaacgtccagccaatacttcgtttacactacgttaccaactaagtaacgtaaaacttacgttgtacttcggtaccagacgagaacgacccgaggtaccncgtaccctacgtaggcttcgactacttatttacggcgtacacgttaccgtacccgggtaacgtcccggtaccncggttaacncgtacggagtcggacgtacgggtcgttccggtaggtacgtacgttactcctacgtactaccagttaccacggaagaccgtacgccgttacgggccgtaaggccgttaaggaacgttcggttaccgtagttaccgttaagtttaacgttacgttcgtaaacttaaacgtaatttaacgtttacttaacgttacggttaccggggttacgtacggtaacccggtacggtaaacgggtaaaccggtaacggttaggtaaccgttacgtaacgtacgggtaaacgtccgtacgggttcggtacgacgtaacccg

SEQ ID NO: 279187 - DNA, 715 bp, Homo sapiens
  misc_feature: GYAE6OF02ICL4G.19.71.G05.1.454.CMB.1.raw
  modified_base (195)..(195): a, c, t, g, unknown or other
  misc_feature (195)..(195): n is a, c, g, or t
  modified_base (359)..(359): a, c, t, g, unknown or other
  misc_feature (359)..(359): n is a, c, g, or t
  modified_base (531)..(531): a, c, t, g, unknown or other
  misc_feature (531)..(531): n is a, c, g, or t
  modified_base (611)..(611): a, c, t, g, unknown or other
  misc_feature (611)..(611): n is a, c, g, or t
tcagtactctcgtgcacgaccggtgctcgatttagtgtcgtcgcaagagagaggggggaggtacaacaggcaggcaggggcagcaaggtggtgttgcagacccaggtcttcatttctctgttgctctggatctctggtcgcccgacggggacagttcgtgactcggaccctagtcctccagcctcccgtggtctntcggggtctcgtgggacgacggccggccacctagtacaacgtcgactagtacccacggaccaactacgtttactttttacacgtacgtttaccaaacctaagtaacgtaaaaaccttcgttaacgtcgttacggaaccacgtacgtaacgacgacgaacggacncgtccgtaccaggctagtcctactagtttacgcggactacgaccggttaacccgggactcccgggttcaacggaccctaggtacctacggacggtaccgagggttcccggtagtaccgggtaacgtaagttaccgtcgttaacctccgtaccgtaacccgtagttaacccgngtaaccgtcgttacccggtagtacgacggtaccgtgtaacgtgtcacggtattacgtttagtactgtaacaataacgttnttacttcgtacttcggtaacgtcggttaccgtacgagggtttaaccagggtaagtctaacgtacgtaacggtactaggtccggaagtttcgacgtccggttaac

SEQ ID NO: 279188 - DNA, 705 bp, Homo sapiens
  misc_feature: GYAE6OF02IW8LV.19.71.G05.1.454.CMB.1.raw
  modified_base (307)..(307): a, c, t, g, unknown or other
  misc_feature (307)..(307): n is a, c, g, or t
  modified_base (533)..(533): a, c, t, g, unknown or other
  misc_feature (533)..(533): n is a, c, g, or t
  modified_base (557)..(557): a, c, t, g, unknown or other
  misc_feature (557)..(557): n is a, c, g, or t
tcagtactctcgtgcacgaccggtgctcgatttagtgtcgtcgcaagagagagggggagagtctgctgaattctggctgaccagggcagtcaccagagctccagacaatgtctgtctcttcctcttctcctgcccgtgcgtcggcctacccagtaggtccgttctgtacaacaacgtacgacgtcgcgacgagcgtacgtcgaccgggtccgaagggtcttagggacaacccggtcccgacgacgaacccgtccctccgttacctcgttacccaccgttgtccaccgtaccgtccgggtaccggganacggtacgtccgtacgacggaccgacgttaggttcgtcgtcgttacgtacgtggtcgtacgtacggcctacccgttaccaggtaccggtagggtacgttacgtagggtcggtacggtggtaaacgggactacttaagttacttcctagttaccgaccgtaaagttaccgggtaataaacgtaaccttaagtttacgccgactacgtcttagttgtacgagccgtanacgagaacgtacgtacgaacgtanaacgacgtaacgtacccgaaacgttaccttcgttacccgtagtacgcgtaacctcgtacgtacctacgttccacggaccctacgggtagtaacggtccgttaatcgtacgtacggtacggaccgtaagtcccgaccttagtgaacccg

SEQ ID NO: 279189 - DNA, 732 bp, Homo sapiens
  misc_feature: GYAE6OF02IW5P1.19.71.G05.1.454.CMB.1.raw
  modified_base (258)..(258): a, c, t, g, unknown or other
  misc_feature (258)..(258): n is a, c, g, or t
  modified_base (312)..(312): a, c, t, g, unknown or other
  misc_feature (312)..(312): n is a, c, g, or t
tcagtactctcgtgcacgaccggtgctcgatttagtgtcgtcgcaagagagaggggggaggtacaacaggcaggcaggggcagcaagatggtgtgcagacccaggtcttcatttctctgttgctctggatctcgtggtcgcccgacggggacagtcgtgatcgacccagtctaccagacctccgtggctgtcgtctcggtgggcgaggccgggccacgatacgaacgtcgacaacgtcacgccaactacttctttaanaccgtacttaccaaactaagtaacgtaaaacttcgttaacgcgtttacgaaccngaccgagaacgacccgaggaccacgcccgttacgagctgacctagtactttacggcggacctacgtaccccggtaaccggggtaggttccccgggtacctacgtaaccggtacttccggaagggttccggaccggtacgggtccgggttgacgggtactaacggttcttaccgtaccttccgtaacctaactcgtaccgtaggaaccttacgaccgtacggacgtaacggttccgaaacggtacgtaacgttgggttacgtacgttaagtttttaactacgttaccggtaaactaagttaatttacttaagtttacgttcgttaacgggtagtacccggtacggttaacgaaccgggttaataacgggtgtaattcggacgttaacgggtaaccgtagttcgggacgttcgtacgtaccg

SEQ ID NO: 279190 - DNA, 719 bp, Homo sapiens
  misc_feature: GYAE6OF02IYJY0.19.71.G05.1.454.CMB.1.raw
  modified_base (240)..(240): a, c, t, g, unknown or other
  misc_feature (240)..(240): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
tcagtactctcgtgcacgaccggtgctcgatttagtgtcgtcgcaagagagaggggggaggtacaacaggcaggcaggggcagcaaggtggtgttgcagacccaggtcttcatttctctgttgctctggatctctggtgcccacggggacatcgtgatgacccagtctccagactccctggctgtgtctctgggcgagcgggccaccatcaactgcaagtccagccacaattccttttanacagttaccaacaatagaaaaacttacttaagtccttggtaaccagcagacgaccaggacacgcctccgtagctgctcattacgnggacntaccgaccggtagtccgggtcccngaccgtattacgagtcgacgacggcgggtcacgggacaaggtctttacgacctctacccgaacctacgtacacgtcccgaacggtccctagggaccgaacgggtcctacggtaaaagggtcgttacggggttacgggtaacctttttaaggttttaaccgttttaagttaccggtttaaacccttaaaacgtaaaacttttacgtttaaacttttaaccttaaacgggttttccggtaacggggtaacgggttttacccgggaccggtaaacggggttaacccggtaaaggggttcgtaaagttaccgtacgtaaccggtaaccggttaacggttcggtacggtcggtaccgtaccgtaaacccg

SEQ ID NO: 279191 - DNA, 579 bp, Homo sapiens
  misc_feature: GYAE6OF02HC5XG.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctccgctcacctgtcgcctatccgtccggggacagacgtcgctagcgacagtgttgcttggctacgtgggtcaggcacgtccccagtcgagacggtctaggaggtggtcgtagggaagactagttattcagtcgtaccaacgtacgtaggtaaataactaaattacgacgactacgatcgtagttgaggtagtcgactagacaatacgaacgtacgacacactacgaacgtaactacgttacctccgtagcgagtacgtctacctgtcgtacgtacgtacccggacgtaaccggacggttcgttaacttacgttaggtcggtacggaaccggtaccggtacccctaagtacgtaacg

SEQ ID NO: 279192 - DNA, 668 bp, Homo sapiens
  misc_feature: GYAE6OF02JMMTG.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaggtgtcctgtcacaagtacagctgcagcagtcaggtccaggactggtgaacgccctcggaccacgacccctctccgctacncctgtcgcctactccggtccgggactagacgtcgctacgcgactacgtggttcgtcttacggccacgtcgggtacgacggtcaccggtaccccatccggaaggtcgttcgtaaggtcggtcggcggtaggggaacgacgttaattacgtttcacgtcggttaaccaacggtacggttaacggaaacttaacgtaaattagtcgaccacctagttacgttaacgggtgaacgtacgtaccgtagtcgaaactactacgtaaaccgtagacaacgtacgtagaaccaacgttcttacccgacctgtaaccgcgtccgtacgtaccctaggtactaccgccgtacccgggaacggtccgttaaggttccgttaaacgtttcgttaaccgggtaggtacccggggtaacgtaccccgttaccccggtataaccgg

SEQ ID NO: 279193 - DNA, 712 bp, Homo sapiens
  misc_feature: GYAE6OF02H6CXU.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctcttcctcttcttcctgcccgtgcgtgggcctcccacaaggtgtcctgtcacaagtacagctgcagcagtcaggtccaggactggtagaacgccctcgcacgacctcgcgctacacctgtcnccatcgtccggggacagagtcgctagcgacagtgttgcttggcacgttcgggtcacggcacgtccccatcggaggtacgggtctaggagttcgggcgtaggggaacgtactatttagttaccattacggtaccgaaacgtacggtaacggtaatttaacaaaagttttaccgtagtacaacccgtaagttaccgtttaggttacggaacggttaacgtaccggtaactacgtaaccgtaaacgttaacccgtaaacggttacggaaacctaacgtaacgtaaccgaaaacgtaaacccgttaacggttttaccctacccgttacggaccgtaaccgtacgttccgttaaacccgtctttacggtacgttacccggtacccggtacgggtaaccgtacgggtaccgtttaaacgttacttacggttacgggaaccgggttaacgggaaccgtacccccgtaagttaaacccgg

SEQ ID NO: 279194 - DNA, 661 bp, Homo sapiens
  misc_feature: GYAE6OF02G2ECP.19.71.G05.1.454.CMB.1.raw
  modified_base (449)..(449): a, c, t, g, unknown or other
  misc_feature (449)..(449): n is a, c, g, or t
  modified_base (550)..(550): a, c, t, g, unknown or other
  misc_feature (550)..(550): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtccaggtccaggactggtagaacgccctcgcacgaccctctcgcctctaccgtgtcgaccacgtccgtaccggggacagacggtcgctacgccggacgagttggttgacgtttcggcgtacgtgggtacgaggccgtaccgtccccagtcgaggtacggtctaaggtacggtcggtaccggtaggggaaaggtactaagttactttacgtatacggtaccaacgtacgtaggaactaagtaaactttatagcctaaccgtnttccggttagttagacgtacgtcgtaacgtacgaacctaaattacgaaacgtacgaacaacgtacgtaacgtaaacgaccgtactttaccgaccgtgaccncgtacctacgtacccgttgtacggtacccgtacgtaaccggtacggtaccgtaacggttgttaacttaggttacgtaggtaacggaaccggtacccgacccgtagtaaccg

SEQ ID NO: 279195 - DNA, 564 bp, Homo sapiens
  misc_feature: GYAE6OF02F0HSR.19.71.G05.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttanacagttccaacaatcgaaaactacttagctttaggtacccagcagacgaccaggacagcctctaggctgctcattactggcatcctaccgggaatccggggtcctgaccgattcagtcggcaggtcggtctgggactagtactttcacttactcaccgtatcgagcacgcctgcngggctagagatggtggctagtttagttatcgtacaaataacttaattgtaacttacgttggtacggtcgttacggtaaccgtaagggaacctaagggtagtaacttacgacgtaaccggaacggttaaccgtggtaggtcccgtagtaccg

SEQ ID NO: 279196 - DNA, 710 bp, Homo sapiens
  misc_feature: GYAE6OF02GRIC6.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacagtcgtgatgacccagtctccagactccctggctgtgtctcgtgggcgagcggccacatcaactgacaacgtccacgccactaattcttttanactagttccaacaatacgaaaacttacttagcttaggtaccagcaaggacgaccaggacacgcctacgtaggctgctcattcgtggcactccgtacccgggtaagtcccggggtcctggaccgtattccgaggtcggaccgtagggtccgggttacgtacggggactacgttacttttaccgaccttcctaccgaaccagtaccgaacgtcacgtcccgtcggtacccgagggtactaaggaacgttaggtcgggttagggtacgtttaagtttttatttaaggtttaaccgtaactaaagttaaacgtttaatttaacgttttaacgtttaccgtttcgggttacgggttaaccggtttccggggaaccggttaaacggggaacccgttaaaggggttaccgggtaacttaagtaccgtaacggtaaccggttaaacgttgggttaccggtccgtacggtacccc

SEQ ID NO: 279197 - DNA, 838 bp, Homo sapiens
  misc_feature: GYAE6OF02JYYZT.19.71.G05.1.454.CMB.1.raw
  modified_base (185)..(185): a, c, t, g, unknown or other
  misc_feature (185)..(185): n is a, c, g, or t
tcagtactctcgtgcacgaccggtgctcgatttagtgtcgtcgcaagagagagggggaggtacaacaggcaggcaggggcagcaagatggtgttgcagacccaggtcttcattctctgtgctctggatctctggtcgccacggggacatcgtgatggacccagtcctccacgactccctggctgngtctctaggcgagcggccacatacacgtgcaagtccagccacgaattctttagacagttccaacgatacgtaaacgtctagtcttaggtaccaggtacaggacctacgaacgggaccctaaggtcccctaccgtaggacttacggtaccttacgtaacgtttaccggtcggggaactaccgttaccgggtaaccccggtaaacgggttccccggggttacctacggttaacccgacttccgtaaggtcggaacccgtaggggtcccggggttaacgcgggtaaacccgtagttaaaccggttttcccgaaccgttaccggtaaccctaaccctaccgttaccggaacgggttacccgtaaccggtacccggttacgtaacccggtaaccggggttaaccggttaacgggtaaaccggttacggttaccggggttacggtacccggtttaaagggtttttacttttaacgtccggttaaaaccgttaaacccgtaaaggttttaacctttaacgtttaacgggtaacccgttaggttacggggttaccgttacccggtaacgtacccgggtaaccgaaagggtttacaacgtttaaaccggtttggaaccggtttacggaacgtttacggacccgggttataccggttacccgg

SEQ ID NO: 279198 - DNA, 624 bp, Homo sapiens
  misc_feature: GYAE6OF02GAMXY.19.71.G05.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (431)..(431): a, c, t, g, unknown or other
  misc_feature (431)..(431): n is a, c, g, or t
tcagtactctcgtgcacgaccggtgctcgatttagtgtcgtcgcaagagagaggggggaggtacaacaggcaggcaggggcagcaaggtggtgttgcagacccaggtcttcatttctctgttgctctggatctctggtagcccacggggacatcgtgatgacccagtctccagacctccctggctgtgtctctgggcgagcggccacatacaactgcaagtccagccacattctttanacagttccaacatagaaaactcttagcttcggtaccagcagacgacctaggacagcctcgaggtctgctactatttacgngggactacgtccgtaccgggaacgtccggggtaccctaggaccgtacttcgacggtcggacgtacggtccgggtcgtagggactaggtactttccaacgtccttaccgacctntacgacgccagtcctgaccgtaggccttaggaagtgtcgtaggtacttagtttacttagttacaacgtaactaatttaactttatttaacgttacgttacggttacgtaccggttcggtaccgaaacgggttacgtagggttaacgtaatacgtacgaagtacgtacgttacggtacggcttacgacctaacg

SEQ ID NO: 279199 - DNA, 599 bp, Homo sapiens
  misc_feature: GYAE6OF02JIMAO.19.71.G05.1.454.CMB.1.raw
  modified_base (247)..(247): a, c, t, g, unknown or other
  misc_feature (247)..(247): n is a, c, g, or t
  modified_base (331)..(331): a, c, t, g, unknown or other
  misc_feature (331)..(331): n is a, c, g, or t
  modified_base (433)..(433): a, c, t, g, unknown or other
  misc_feature (433)..(433): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagccgggccaccgatcaactgacaagtccagccactaattcttttaanacacgttccaacaatacgaaaactacttagcttacggtaccagcagacgacaggacacgcctcctaggctgctactatttacgngggctacgtccgtacccgggaacgtccgggggtaccctaggaccgtattcgagtcggcaggtcgggtacgtcgggactacgtactttcacctctaccactancgagccacgtaccgtgcgagctagaacgntgngtacttagtttatacttagtacaagtaattactttattacttacgttacgtggtaccgttcggaccgtaagggtaacgagggttacgtaacttacgtacgtacgtaacgtacgtaggtcggtacgtacgtaccg

SEQ ID NO: 279200 - DNA, 692 bp, Homo sapiens
  misc_feature: GYAE6OF02IYF62.19.71.G05.1.454.CMB.1.raw
  modified_base (243)..(243): a, c, t, g, unknown or other
  misc_feature (243)..(243): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgccccacggggacatcgtgatgacccagtctccagactccctggctgtgtctctgggcgagcggccaccatcactgcaagccagccactaatcttttanactagttaccaacaatagtaaaaactacttacgcttacggtaaccaggacaggacgaccaaggacacgacccgtcctacggtctgtcctctactttacgtgggacacttccgtaacccgggacgtccccggggtccctacggacccgtagttaccgaggtggaccgtagggtccgggtcgtagggactaggtactttccgaacttctaccacacgtcgaacgccgacgcccttggaccgtacggtcctaagtaacgtagttcggtacgggtcctttaagtttttagttactttacggtaaacttaaaaccgtaaattttaacgttaactttaagtttaccgtttcgggttacgggttaacccgttttacccgggaaccggtaaaaccgggtaccggtaaaggggttacgtaacgttaaccgtaggaaccggtaaccggtaggttaccgg

SEQ ID NO: 279201 - DNA, 604 bp, Homo sapiens
  misc_feature: GYAE6OF02FG2TT.19.71.G05.1.454.CMB.1.raw
  modified_base (241)..(241): a, c, t, g, unknown or other
  misc_feature (241)..(241): n is a, c, g, or t
  modified_base (387)..(387): a, c, t, g, unknown or other
  misc_feature (387)..(387): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggtacatcgtgatgacccagtctccagactccctggctgtgtctctgggcgagccgggccaccgatcacgtgcaagtccagccacaatcttttanacagttccaacatgaaactctagcttggtaccagcagacgaccaggacagtcctcctagctgctcattactggcatccgtaccggtatccggggtcctgaccgattccgagtgcaggcggtctgggacagtactttcactctcacntcagtcacgcctgctaggcttagaagtactgtcgtacttagttttaactattacgttaacaaacgtaaactttaatttacttaacgttaaccgtttcggtacgttaccggtttaccggaaccggtaacgggtaacccgtaaaggggttacgtaacgttaacgtaaccggtaacggtaaccgttaaaccgttggttaccgggtacttacggtaacccg

SEQ ID NO: 279202 - DNA, 703 bp, Homo sapiens
  misc_feature: GYAE6OF02IRHI3.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagcggccacatcaactgacaagtccagccactaacttcttttaatacagttaccaaacaatagaaaacttacttagcttacgaccagcagacgaccaggacacgcctaccgtaggctgacctactatttacgcggactactcccgtaacccgggacgttcccggggtaccctaggtacccgtattccgaggtcggacgtagggtccgggttacgtcgggaactacggtacttttacccgacgtttcccacgtaaccgtactaccgacgtacccgtacgtcccgtaggaccgaacggtcgtaaggaacgtgttacgggttacgtaacgtttagttttaatttacgtacgttaaccgtaaaattaaactttaactttaacgtttaacttacccggtttaggttaccgggtaaaccggttttaccggggaaccctaaaacggggtaacccgttaagggttacgtaacgttaacgtaacgtaaacgggtaccgtaacgttcggg

SEQ ID NO: 279203 - DNA, 657 bp, Homo sapiens
  misc_feature: GYAE6OF02I3Z7B.19.71.G05.1.454.CMB.1.raw
  modified_base (254)..(254): a, c, t, g, unknown or other
  misc_feature (254)..(254): n is a, c, g, or t
  modified_base (548)..(548): a, c, t, g, unknown or other
  misc_feature (548)..(548): n is a, c, g, or t
tcagtactctcgtgcacgaccggtgctcgatttagtgtcgtcgcaagagagagggggagtacaacaggcaggcagggcagcaagatggtgttgcagacccaggtcttcatttctctgttgctctggatctctggtcgcccgacgggacagtcgtgatcgacccagtctccagacctccctggtctgtcgtctcgtggcgagccgggccaccatacaactcgacaacgtccacgacctaactaatttcttttaanactacgttaccaaactaagtaacgaaaaacttcttaacgtctttacggtaaccagtaccgaagacgaaccgaaggtaccacgtacctaccgtaggtacctcgtacctctaagtttacgcgggactacgttaacccggaccgggtaacgtcccgggtcctaggaaccgttgtaccgaggtcgacgacggtcggtcgtacggactagtacttcgacgttcactacgtaactcgacgctacgacgttcgacgtcgcgtaagatgtacggcgttaagtaccttagtacgttacctaanaaaccgttaattactttacgtacttcggtaacgtacgtaccgtacgtacgaaccggtaagtaacgtgtaactacgtaagcgtaacgtacgttggacggcgtacgaaccg

SEQ ID NO: 279204 - DNA, 670 bp, Homo sapiens
  misc_feature: GYAE6OF02JSL6F.19.71.G05.1.454.CMB.1.raw
  modified_base (456)..(456): a, c, t, g, unknown or other
  misc_feature (456)..(456): n is a, c, g, or t
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctctggtgcccgacggggacatcgtgatcgacccagtcctccagacctccctggctgtgtctcgtgggcgaggccgggccaccatacaacgtcgacacgtccacgccaactaacttctttatacacgttaccaactaatagtaaactacttagtcttacggacagacagacgaccgagacacgccgtacgtaggctacgtctactagttacgtggactacgtccgggtaaccggtacggtccgggtcctaggtaccgtatccgaggtacggacgtaggtcgggtacgtacgggacgtacgtacgtttccacgtcctacgaccnctacgacgcgacgtccgagtacgaggtcgtaagtacgtacgttcgggtagtacgtttactttaagtcttagtaataaccttaagtttaactttacgttacgttacgttacgggttacgtaccggttacggtaccgggtaacggtaacggtacggttcgtaacgttacgttacggaacggaacggtttcgtaacggtcggtccgtacgtaaccgg

SEQ ID NO: 279205 - DNA, 722 bp, Homo sapiens
  misc_feature: GYAE6OF02JAECP.19.71.G05.1.454.CMB.1.raw
  modified_base (458)..(458): a, c, t, g, unknown or other
  misc_feature (458)..(458): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
  modified_base (665)..(665): a, c, t, g, unknown or other
  misc_feature (665)..(665): n is a, c, g, or t
tcagtactctcgtgcacgaccggtgctcgatttagtgtcgtcgcaagagagagggggaggtacaacaggcaggcaggggcagcaagatggtgttgcagacccagggtcttcatttctctgttgctctggatctctggtcgcccgacggggacatcgtgatcgaccctagtctccagtacctccctggctgtgtcctcgtgggcgaggccggccaccatcaactgacaagtccagccatacttcttacgtactacgttacccaaactaatacgaaaaccttacgtacgtcctttaggtaccaggcaagacgaccacgggacaccggtccttccggtagtccgtcgaccttgtaacgtttcgtcgggtaccacgtacccggtaacccggggtaccgtcccggggtcctagggaccctattccgaaggtcggctacgggcgggtaccgtaggactacgttntttccacgtccctacgaacctacgtccgacnccgtagaccctcggtacgaacggtntaaggtaacgtggttcggtcgtaacctttaaggtttttattacggttaacctaactaaaacgtttatttaatttaaaccttggttttaacccgtttccgggaagttcccgggttaacgtaacggtaaccgggtaacggtaacgggttttanaaccggtttacaccgttaagggtaccgtaagttaccgggtggtaccttagaaccccg

SEQ ID NO: 279206 - DNA, 725 bp, Homo sapiens
  misc_feature: GYAE6OF02I3RXM.19.71.G05.1.454.CMB.1.raw
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctcgtggtcgcccgacggggacatcgtgatcgacccagtctccagacctcctggctgtgtctcgtgggcgaggccgggccaccatcaactcgacaacgtccacgacctaactaactttcttttaactactacgttaccaaactaaataacggtaaaaaccttacttacgtccgttacggtaaccagacgaacggacgaaccgaacggaaccacgtaccctaccgtacggcctcgcttaccttaagtttcgtcgggactacgtaccggtaacccgggacgttccccggggtcctacggaacctacgttcgaacggtcggccgtagggtacgggttcgtacggggacctaggttacctttccactccgtaccaccgtactcgtacgcacgtcctggacgtagggtacctaaggtaacgtaggttcgtacggttacgttagtttaattacgttacgtaactaaagttaacttagtttaacttaattacggtttacggtaacggtaccggttaccggaaccggttaaggggacgtaaggtaacgtacgtaacgtaccggaacggtaccgtaacgttggtacggtccgtacggtaccg

SEQ ID NO: 279207 - DNA, 613 bp, Homo sapiens
  misc_feature: GYAE6OF02IRYC0.19.71.G05.1.454.CMB.1.raw
  modified_base (239)..(239): a, c, t, g, unknown or other
  misc_feature (239)..(239): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagtactctcgtgcacgaccggtgctcgatttagtgtcgtcgcaagagagagggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcggccacatcaactgcaagtccagccactaattctttanacacgttaccaaacaaatagtaaaaactacttaagcttaggtaccagtcagaacgaccgaaggacacgcctacctaggctgctactatttacgngggctatcgtacccgggatccggggtccctgaccgtntcagtgcagtcggtgtgggacagatttacactcncaccntcagcngctgcaggctagacgtgtgttggcttaagtttacttagttacgtactaaaactaagtttaactttagtttaattaccgtttacggtacggttaccggtttaccggaaccggttaaccggggtaactaaagggttacgggtaacttaacgtaaccggaagttaaccgtaaacggttgggtacggtcctaggtaaccccg

SEQ ID NO: 279208 - DNA, 858 bp, Homo sapiens
  misc_feature: GYAE6OF02IHBUU.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacagtcgtgatcgacccagtcctccagacctccctggctgtgtctcgtcgggcgacggccgggccaccgataccaacgtaggactaacgtccacgaccaactaattcttttacactacgttaccaaacaattaacgaaaacttacgttagcctttacggtacccaggtacacggaacgaaccgaggtaccaccggtccctaccgtaggaccttgacccgttattaacttttacggcggtactacgttacccggtaaaccccggggtacggtttccccggggtaccctacggtaccggtattaccggaagggtccggaccgagggtcccgggttactacgggggtaacctggtttacctttaaccgacccgtttaccctaccgaaaccccttagtacccgacggtaccgtacccggtacccgtcggaaccgaccgggtaccttaaggggtaacgttaacgggttacgggttacgggttaaaccgttttaggttttttaaagtttttccgttttaaacggttaacctaaaacgtttaaaacgtttaacttttttagttttaaaccggtttaccgttttaaccggggttaccggtttacccgggttttacgggaaaccccgggttaaacggggtaaacccgtaagggggttaccggtaacgtttaaaccggtaccggaaaccgggttaggtaacccggttagggg

SEQ ID NO: 279209 - DNA, 692 bp, Homo sapiens
  misc_feature: GYAE6OF02GQNZQ.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctccacctgtcgccatccgtccggggacaggtacgtcgactacgcgacagttgttgcgttgcacgtgggtcaggcacgtccccatccggagacggttctaggagttcgggcgtaggggaaggtaactaattactttcagtcgtaccaacgtacggtagtaataactaaattatacgaccactaagtcgttaggttagaacggtacgttacgaacgttacgaactaacgtaccgtaaacggtacaaccgactaacgtaaccgtaaaacgaacccgttacgttacccttaccccggtagaccgtaacggtcccgttaaccgtcccgtttagtacgggttacccggtaccccgttaccccgggaaacgggttaaccggtaaccggggttagtttaaactttacgttaaaccggttcggggttaacgggtaaaccgggaccccggaaccccttaaggttaaccgaacgg

SEQ ID NO: 279210 - DNA, 726 bp, Homo sapiens
  misc_feature: GYAE6OF02FH23T.19.71.G05.1.454.CMB.1.raw
  modified_base (315)..(315): a, c, t, g, unknown or other
  misc_feature (315)..(315): n is a, c, g, or t
tcagtactctcgtgcacgaccggtgctcgatttagtgtcgtcgcaagagagagggggtcaggctggaactgaggagcaggcgaggggcagcaagatggtgttgcagacccaggtcttcatttctctgttgctctggatctctggtcgcccgaaggggacatcgtgatcgaccctagtctccagacctcccgtggctgtgtctcgtgggcgagcgggccactatacaactgactagtccagccactaattctttacacacgttccaaactaatagaaaactacttacgtcttaggaccagcaagacgacagacacncctacgtaggctgtcctagtactttacggcggtacctagttacccggtacccggggtaacggtccccggggttaccctacggtaacccggttactttacggacggtacgggaccgtacgggtccggggttacgtaggggtaaccgtacgggttaacctttcgaacccgtttctacccgtaccgtaacaccgttaacggccaccgttaccgtacgggacgtacggccgttaggaacgtacggttcggtacgttaacgtttaagttttagtttaacgttaagttaacctaaacgttaaatttaacgttttaatttaaccgtttacgttacggtacggttaacccggtaccggtaaccggtaacgggttaaccgtagggttacgtaactagtaccgaacggttacgtaggtccg

SEQ ID NO: 279211 - DNA, 657 bp, Homo sapiens
  misc_feature: GYAE6OF02IMHSG.19.71.G05.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccntcaactgacacgtccagccacaattctttanacagttccaacaatagtaaaactacttagcttggtaccagcagagaccaggacagcctcgtaggctgctctatttcgnggtcacgtccgtacccggatcccgggtcctcgacgtatcgagtcgcgaggtcggtctagggactacgttactttccgacttccgtacctaaccacgttaccaacgtaccgtacgtccgtacggccgtaagggtaccgttaacggtaacggtattacgggtacggtacgtttaagtttttacgttaacgtttacgtaaccttaaataattttaatttaagtttaaccttacggtttaccggtacggttacggtttacccggaacccggtaaacggggtactaaacggggttctaacgtagtaacgtaggaaccgttaacgtggtaccggtactcgtaccg

SEQ ID NO: 279212 - DNA, 670 bp, Homo sapiens
  misc_feature: GYAE6OF02HU9A4.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccacggggacatcgtgatgacccagtctccagactccctggctgtgtctcgtgggcgacgcggccacactcaaactgacaacgtccagcctaactaattcttttaataaccagtttaccaaactaatacgaaaaactacttagcgtttaggaaccagactaagaacgtaccgaaggaaccagccctacgtaagggcctgacttactatttaaccgtgggactacgtaccgtacccggggaactcccggggtacctgacccgtattcacgtggctacggccggggtactcgggaactagtactttaccacgttcctaccaacgtactaccgaacgtccgtacgtaccgtcgactacgggacttaggaagtacgtcggtagtaacttagttttaacgttattacggtaacctaaattaaagttaatttaattacgttacgtttcgtacggtaaccggttccgtaacccggaaagggtacccgtaaagggttcggtaataaccgtacgaacgtaccgaagttacgg

SEQ ID NO: 279213 - DNA, 624 bp, Homo sapiens
  misc_feature: GYAE6OF02I82MW.19.71.G05.1.454.CMB.1.raw
  modified_base (239)..(239): a, c, t, g, unknown or other
  misc_feature (239)..(239): n is a, c, g, or t
  modified_base (618)..(618): a, c, t, g, unknown or other
  misc_feature (618)..(618): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaacgtccagccaacattctttaanacacgttaccaaacaatacgaaaaactacttaagtcttaggtaacctacgacaagaacgaccgaaggaacacgccctaccaggccgtgactctaattttacgcgggtctaacgtccgttaaccccgggaagttcccgggggtaccctaggaacctaattcgaacggttggcgaaggccgggtacgtgggaactaggtacttttaccgactctacccacctatccagtcctaacgcctgtaccgagggtctaaggaagagttcggtagtactagtttaagttattacggttacaaacttaattattattaagttacgttacgtgtacgttcgacgaacggtacgaaggtacgatagtacgaagtacgaagtgacggtacnggaacc

SEQ ID NO: 279214 - DNA, 687 bp, Homo sapiens
  misc_feature: GYAE6OF02JUAN9.19.71.G05.1.454.CMB.1.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctcgggcctcccacaaggtgtcctgtacacaagtacagcctgcagcagtcaggtccaggactggtagacgccctcgcacgtaccctctcgctacnccttgtcncctatcgccgggacagacgtcgctacgcgaatgttgtcgtcgttcggactacggtcgggtccgaggtccgacccgttaccccgagtcgggaggtaaggttacctagggtaggtcgggccggttaggggaaacggtactagtttactttcgagtaccgtaccgaacgtacggtaggtaaattaacgtaaatttactcgaccacctagtcgttagtaggaagcgtaccgagtacgtaactaacgtacgtaaacgttacgaaccacgtaaacgtaccggaaacgtaacccgttagttacccgtccgtagtacacgggttctaccgtaccgtacgttacgtaccgacccgttacgggtaaccggacggttaacggttacgtaaatttaccggttaaggttaccggaaggtacccggtaacccggtaaccccgttagtaaccgtaaccg

SEQ ID NO: 279215 - DNA, 708 bp, Homo sapiens
  misc_feature: GYAE6OF02GCZIP.19.71.G05.1.454.CMB.1.raw
  modified_base (470)..(470): a, c, t, g, unknown or other
  misc_feature (470)..(470): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatgacccagtctccagactccctggctgtgtctcgtgggcgaggccgggccaccatccaactgacaacgtccacgaccaactaatttccttttaataccgtacgttaccaaacaaatacgaaaaaccttacttaagctttacggtaaccagcaagacgaccaggacacgcctaccaggctcgcctctagtttacgtgggacacgtccgtacccgggtacgtcccggggtacctcgaccgtattcgagtcgcgtaggcgggtcgtcgggactaggtacttcactctacacctatacacgtcgacgtccagacgnggtctaggaaacgttgtacggttgacgtttagttttaacgtttagttactaaccgtaaacgttaattttaacgtttaatttaaccgttaaccgttttacggggttaccgggttaacccggtttaccgggtaacccggtaaacggggtaaccggttaaggggtaacggttaacggttaacttaaccgggtaacggtaaccggttaccgtaggggttaccggtacggttaccgtaacccg

SEQ ID NO: 279216 - DNA, 753 bp, Homo sapiens
  misc_feature: GYAE6OF02F7W2F.19.71.G05.1.454.CMB.1.raw
  modified_base (328)..(328): a, c, t, g, unknown or other
  misc_feature (328)..(328): n is a, c, g, or t
tcagtactctcgtgcacgaccggtgctcgatttagtgtcgtcgcaagagagagggggtcagggctggaactgaggaggtacaacaggcaggcaggggcagcaagatggtgttgcagacccaggtcttcatttctctgttgctctggatctctggtcgcccgacggggacatcgtgatcgacccagtcaccagacctccgtggctgtcgtctcgtgggcgaggccggaccacatacactgacaacgtccgacgaccacgtaattcttttaacaactacgttaaccaaacgtaataacgtaaaactacgtttagcctttacgggtaaccnggtacgaaggaaccgtaaccgaagggaccacggtcccgtaccgttaggcctacgtctaccttagtttaccggacggctaccgtccggtaacccgggttacggtccccgggtaccttacggaaccgttaactcgtacggggtacgcggtaacggggtccgggtaccgagggtactacggtacctttacggacccttccgtaccgaacctacggacgacggtccgacggtccccggtagaccgtaccggtacgtaaggaaacggttcgttgggggtaacctaggttttaaaggttttacttaacgtttaccgaacttaaacgttaacctttagtttaacttaccgttacgtttacgggttacgggtaccggtttaaccgggacggttaaacgggacggttaaggtagtaacgttacgactaaccggg

SEQ ID NO: 279217 - DNA, 663 bp, Homo sapiens
  misc_feature: GYAE6OF02HDZP5.19.71.G05.1.454.CMB.1.raw
  modified_base (238)..(238): a, c, t, g, unknown or other
  misc_feature (238)..(238): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagacgaccaggacagccctactaggctgctctatttacgngggactagtaccgtaacccgggaacgtcccggggtaccctggaccgtattcgaggtcgcaggtccgggtacgtgggactagttacgttccactccgacactcgtacgacgtacaccgtcgtcgacgcggtacgtaaggacgttagtgggttagtacgtttaggtttaagttacgttacgtaacctaaatttaacgtttaatttaaacgtttaacgtttaacggttacgggttacggttaaccggttacccggtaaccgggtaacgggtaacggttaaggggttacgtaaacttaccgtaagtaacggtaaccggtacgtcgggtacgtaccggtacctaacccg

SEQ ID NO: 279218 - DNA, 661 bp, Homo sapiens
  misc_feature: GYAE6OF02I5QCM.19.71.G05.1.454.CMB.1.raw
  modified_base (259)..(259): a, c, t, g, unknown or other
  misc_feature (259)..(259): n is a, c, g, or t
  modified_base (656)..(656): a, c, t, g, unknown or other
  misc_feature (656)..(656): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggtatctctggtcgcccgacggggacatcgtgatcgaccagtctccagcctccctggctggtgtctcgtgggcgacggccgggaccaccatcaacgtcgacaacgtccacgcccaataactttccttttaanaacctacgttaccaaactaaattaacgtaaaacttacgttagtccgttacggtaaccagacaaggaccgacaggacacgccttcgaggcctgcctacgtatttacgtggactacgtacggtacccggtacggtccccgggtcctacgacggtacttcggacggtcgacggtacggtcgggttacggacggtacgtacgttactttccacttcctaccacctagtccgagcctacgtccaggaccgtaggtcgaaggtagtacgttaggtacggtatttacgtttagttaacttacgtactaaagttactttaagttactttaacgtacgttagtcggtaccgtacgacggaacgggtaacgtaggacgtatacgagacgtacgtagtggtcgacgtntaccg

SEQ ID NO: 279219 - DNA, 789 bp, Homo sapiens
  misc_feature: GYAE6OF02GEF2Z.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctcgtggatctcgtgggtcgcccgacggggacagtcgtgatcgaccctagtcctccagacctccgtggctgtgtctcgtgggcgacggccggaccacgtatcgaactgacaacgtccacgaccaactaactttcttttaacgacgtacgttaccaaacaagtaacgtaaaacttcgttagcgtttacggaacctagctaaggaacgaccaggtaccacgtacccttaccgtaggccttcgccttacgttaacgtttacgtcggggacctacggttaccccggtaacccgggtaacgttccccggggttaccctaggtaacccgtagtttccgagggttaccggtacggacgggtcgggttaccgtagggggaaccttaggttaccttttacccgacttcccgtaacccgtacctacgtaaccgacgtaccgtaacgtcccgtagacgtaacggtaccgttaagggaacgttcggtggttaccggtactttaagtttttaacgttacgttacgtaaccgtaaattaacgttttagttttaactttaccgttaacggtttacgggtaccgggttaaccggttcggtaaccgtaacggggtaaccttaggggtactaacgtacgttaccgaagtacccggtaagttcgggtaccgtccgtaacgtacccg

SEQ ID NO: 279220 - DNA, 622 bp, Homo sapiens
  misc_feature: GYAE6OF02G172B.19.71.G05.1.454.CMB.1.raw
  modified_base (497)..(497): a, c, t, g, unknown or other
  misc_feature (497)..(497): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcggcagaccctctcgctcacctgtgccatccgtccggggacaggacgtcgtctagcgactagtgttgcttggctacgtggggtcacggcacgtccccagtccggagtacggtctaggaggtgggcgtaggggaaggacatttatttcattcgtaccaaacgtacggtaggtaaactaactaaatttacgtgaccgacctatcttggttaggagtagtacgacttacgaacaagtacctaacgtacgaactacaactaccgaaacgtaacctacgttccctaccgtnacgaacgtcgttaccgaccttacgtcgtcgaccgtccggaacggtaaccgtacgggttacttaacgttaacgttacgttacgggtaacggtacggacccggtaaccccgtagttaacggtaaccg

SEQ ID NO: 279221 - DNA, 772 bp, Homo sapiens
  misc_feature: GYAE6OF02GU88J.19.71.G05.1.454.CMB.1.raw
  modified_base (585)..(585): a, c, t, g, unknown or other
  misc_feature (585)..(585): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggcgggccaccatacaacgtgacaacgtccacgccaacaattccttttaatactacgttaccaaactaaatacgtaaaaaccttacgttacgtctttacggtaaccagaccaaggacgtaaccgaaggaacctacggtccctaccgtaacgggctcggacctactaagttttaccgcgggtacctaacgttaccccggtaacccggggtaacgttccccgggggtacccctacgggtaacccgtacgttaccgacgggttacgggaccgtaacggggtccggggtaccgttacggggaaccgtaacggttaacctttttaccgaccgtttacccgtaccgtaacctaacgttacaccggtaccacgtaccgtacgacgtacgggntaagaacgtagttcggtacgtacgtttaagtttaacgtttaagtacgtacgtaaacttaatttaacgtttaacgtttaaccttacgtttacggtacgggttaccgtaccggtaaccggtaacgggtaaccgtaaggtacgtaacgttactaacgtacgtaacgtacgttaggtcggtcgtacgtacc

SEQ ID NO: 279222 - DNA, 696 bp, Homo sapiens
  misc_feature: GYAE6OF02JLZ9R.19.71.G05.1.454.CMB.1.raw
  modified_base (96)..(96): a, c, t, g, unknown or other
  misc_feature (96)..(96): n is a, c, g, or t
  modified_base (219)..(219): a, c, t, g, unknown or other
  misc_feature (219)..(219): n is a, c, g, or t
  modified_base (605)..(605): a, c, t, g, unknown or other
  misc_feature (605)..(605): n is a, c, g, or t
  modified_base (691)..(691): a, c, t, g, unknown or other
  misc_feature (691)..(691): n is a, c, g, or t
tcagtactctcgtgcacgaccggtgctcgatttagtgtcgtcgcaagagagagggggagagtctgctgaattctggctgaccagggcagtcacagngctcagacatgtctgtctccttctcttcttcctcgccgtgcgtcggccctacccacgaaggtctcctgtacactaagtaccacgtctgcgagtacagttcgacggtccgaagggtcttggganaaccgtccctacggcaaccgtaccccgtctccgcctccacgtcgtcggacctcgttccggtccggggaacacggtcgtccgacgtaccggaccgtaggtagtttcgggttcgtacggttcggctaaccggggttggacccggaacgggccctaacccgttcccgagttaccgggaaacgggtggttactaaggggtcgggttaccgacggggttagggaaaacgtccgtaatttaccgttagccgtttacgaaccgtaggtacgtaagtaacctaaagtaacgttaagcgaactaccgtaagtcgttgtaagtacgtaagtacgtacgttacaacgtaactacgaagtaacgacaatagaactaacgaccgtattccgactccganacgtacgttcacgtcacgaccgaccgtacggacgtacgttaggtacttattacggttcgaggttaccgagtcccgaacgttaccgngtacc

SEQ ID NO: 279223 - DNA, 634 bp, Homo sapiens
  misc_feature: GYAE6OF02FO30D.19.71.G05.1.454.CMB.1.raw
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctctggtgcccacggggacatcgtgatgacccagtctccagactccctggctgtgtctctgggcgagcgggccaccatcaactgcaacgtccagccaacaattcttttatactacgttaccaaactaatagaaaactacttagctttaggaccagacaggagaccaggacacgtcctccgtaggctgctactatttcgtcgggtcagtccgtacccgggaacgtcccggggtccctaggtaccgtattcgacggttcggcgtaggtcgggttcgtcgggactagtactttcacgtcctacaccgatccgagctacgacctgactacggctagaagtgtggtacgtctagtttattagtagtaacctaattaattaactttaattacgttacgttcggttacgggttaccgttcggtaccggtaacgggtaaccgttaaggttacggtaacttacgtacgtaacggtaccgtaaacgttgggtacggtacgtacgtaacccg

SEQ ID NO: 279224 - DNA, 595 bp, Homo sapiens
  misc_feature: GYAE6OF02IKY8K.19.71.G05.1.454.CMB.1.raw
  modified_base (354)..(354): a, c, t, g, unknown or other
  misc_feature (354)..(354): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccgacggggacatcgtgatgacccagtctccagacctcctggctgtcgtctcgtgggcgagccgggccaccatcaactgacaacgtccacgccactaattcttttaataccacgttaccaaactaatagaaaaccttacttagcctttaggtaccagcaagacgaccgaaggacacgtcctaccgtaggctcgcttactagtttacgnggactacgtccgtaaccgggacgtcccgggtaccncggtacgtctacgngtcggcacgggtccggtcgtggactacgtattcactctacactatcacgcacgctcgcgagctagagtcgtagcggtattaacgtttattagttcgtaactaaacttattaatttattacttcgttaggtcggtacgttaccgaacggtaacggtacgaagggttcgacgttacgacgaagtacgagttcgg

SEQ ID NO: 279225 - DNA, 566 bp, Homo sapiens
  misc_feature: GYAE6OF02IE1PP.19.71.G05.1.454.CMB.1.raw
  modified_base (245)..(245): a, c, t, g, unknown or other
  misc_feature (245)..(245): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttatctgttgctctggatctctggtgcccacggggacatcgtgatgacccagtctccagacctccctggctgtgtctctgggcgagccgggccaccatcaactgacaagtccagccaacaattcttttaanacagttaccaacaatagaaaactacttagcttgtaccagcagagacagacacgcctctaggctgctctatttacgnggcatccgtaccgggaacgtccggggtacctcgaccgtntcgagtcggcaggcgggtctgggactagtactttccacttccacacctatacacgtacacgtcctgcgaggctaggaagtgtgtgtcttaagtttattagttagactaataattaattattatacgttcgtagacgttacggacgtaacgggtaactaaggtcgtaattacgacgacgtaacgtaacgtggtcggtcgtagtaccg

SEQ ID NO: 279226 - DNA, 696 bp, Homo sapiens
  misc_feature: GYAE6OF02G59WQ.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccacgactccctggctgtgtctctggcgacgcgggccaccatcaactgcaacgtccacgaccactaattcttttagtacacgttaccaaaccaatagtaaaactaacttagtcttaggtaccagcgagagaccagacacgcctccgtaggctcgctctatttacgcggctactccgtacccgggactccgggggtccctgaccgacttcgagttcggacgacggtcggggtacgtcggggaacgtaggtacttttacaccgttacctaccgaaccctagtaccgacgacctaacggtcccgtacggaccgtacgggacgttacggaaaggtagttggtcggtaacttacggttttaactttacgttacgttacctaaaacgttaaatttaacgttttatttaaacttacggtttaccgtcgggtaaccggttttccggaaccggttaaacgggaaccggtaagggttacggtaacggttaacttacgaacggtaaccgtaagttacggtacgggttcctaggtaacccg

SEQ ID NO: 279227 - DNA, 716 bp, Homo sapiens
  misc_feature: GYAE6OF02G7OB4.19.71.G05.1.454.CMB.1.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactgggtgaacgccctcgccacgacccctcgtccgcctccacctcgtcgccagtccgtccggggacagacgtccgactaggcgacgtagttgttggtcttcggctacgtcgggtcgacggtccgaccgtaccccagtacggtaggtacggtacgtaggacgggtagggtacggtaggggaaacggtactaagtttacgttactaacgttcgtaacccgaacgtacgtaagtaaataaacgttaaattatacgacctaacctattacgtttaggtacggagtaccggtacgacgttaggaactaacgtaaccgtaaacgttacgaaccaatacgtaacgtaaacgtaaccttaacgttaccctaccgtacgtcgaccttacgtcccgtaccgttacgttacgacccggttacggtacccggtaacgggtaaccggttaacgggtttaacgttacgttaacgtttcggttagggttaaccgggtaacgtaccccggtaaccccgtaggttaccgtaaccg

SEQ ID NO: 279228 - DNA, 670 bp, Homo sapiens
  misc_feature: GYAE6OF02JPD05.19.71.G05.1.454.CMB.1.raw
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagtactctcgtgcacgaccggtgctcgatttagtgtcgtcgcaagagagaggggggagggtacgaacaggcaggcgaggggcgagcaagagtggtgttgcagacccaggtcttctatttctctgttgtctctggatctctggtcgacccgacggggacatcgtgatcgacccagtctccagacctccctggacttgtgtctcgtgggacgaggccgggaccaccgatcaagtcagacgtccacgcctactattacttttanacgcgttacccaanaactacgtaaactacttagtaccgttaggtaccagtacgaagacgtaccgaggaccncgacctaccgtacgngtcgtcctactacgttttcggcgggactaacgtaccggttaacccgggacgttacccgggtccacgtacccggttatccgtacggtggacgtacggcgggtaactcggggaagtagttacgtcaacgttcctacacctcgacncgtacnccgtactcgtacgcgtagtacgaagtacgtgtcgtagttagttacgttattacgtaactaacgtaaattacttaagtttactacgtttacgtcggttacggtaccgacggaaccgggtaaggtaacggtaggtataacgtgaacgtaccgtacgtacggtacgcgttagacc

SEQ ID NO: 279229 - DNA, 798 bp, Homo sapiens
  misc_feature: GYAE6OF02H7T09.19.71.G05.1.454.CMB.1.raw
  modified_base (250)..(250): a, c, t, g, unknown or other
  misc_feature (250)..(250): n is a, c, g, or t
  modified_base (355)..(355): a, c, t, g, unknown or other
  misc_feature (355)..(355): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctcgtggtgcccgacggggacatcgtgactcgacccagtcctccagacctcccgtggctgtgtctcgtgggcgaggccggccaccatacaactgacacgtcacgccaactaattctttanactacgttaccaaactaagtagaaaaccttactagtaccttacggaaccacgacacgaacgaaccgaaggaccacgtcctcgtaggccttgctagtactttacgnggacacgtaccgtaccgggaccgttcccgggtcctacggtacgtagttcgaggggtcgacgtcgggccgggttcgacggggacctacggttactttccgtaccgttccgttacccaacgtaacgtaccgtaacgtaccggtacgtcccgtacggacggtaccggtacgttaagggaaacggtacggttacgggtagttacgtttaagtttttaacggtttacggttttaactaaccgtaaaaccgtttaagttttaacgtttaagtttttaaacccggttacggtttttaccgggttaccggggttaacccgggtttaccgggtaaccggttaaaccggggggtaacccgtaaagggggttaccgttaaagttaccggttaacgaaaccggtttaacgggttaaccggttagggttacccgggttacggtacccggtaacccg

SEQ ID NO: 279230 - DNA, 703 bp, Homo sapiens
  misc_feature: GYAE6OF02IMDSS.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatgacccagtctccagacctcctggctgtcgtctcgtgggcgagccgggccaccatcaactgacacgtccagccactaattctttanactagttacaacaatagaaaacctacttagtacttacggtaaccagcaagacgaccgacgacacgcctaccgtaggcctacgtctacgtatttacgcgggactacgtacccggtaaccgggaacgttcccgggggtccctacggtaacccggtagttacgtacggtaggaccgtaacggtcggggtacgtacggggaactacggttactttaccgaccgtttacctaccgaacctactacgaccggtactacgtccgtacgccgacgtacgttaacggtaaacgtacgttcgggtacgttacgtttaagttttatttacggtttaacgtaactaaacttaacgtttatttaagttactttacgttacggttacggttaccgtacggaccggtaacggtacgttaacggtggtaactacgtacgacggtaacggtaacgttggtcgtacggtcgtaaccg

SEQ ID NO: 279231 - DNA, 765 bp, Homo sapiens
  misc_feature: GYAE6OF02HRWEF.19.71.G05.1.454.CMB.1.raw
tcagtactctcgtgcacgaccggtgctcgatttagtgtcgtcgcaagagagagggggagggtacgaacaggcaggcaggggcagcaagatggtgttgcagacccaggtcttcatttctctgttgctctggatctctggtcgcccgacggggacatcggtgatcgaccagtctccagactcccgtggctgtgtctcgtgggacgacggccgggaccaccatacaacgtgacaacgtccagccaatacttcttttaacaccgtaacgttacctaacaagtacgtaaaaaccgttcttacggttcttaccgggtaacctacggacgaacggtaaccgaacccggtagggaacctacggttccccgttaccgtaacgggtacctttcgaccgtttaacgtacgtttaacggtcggggaaccttacggtacccggtaaacccggggggtaccgtttccccgggggtaccccttagggtaaccctaggtaccgttaggggtaccggcggtaaaccggggttccggggtcgttacgggaacgttaggttacctttcccgaactccgtaccaacgtcgttacgaaccgcgtaaccgtccggtacgacgaggtacgaggtaacgtagtcggttacggacgttatttacgttactacggactaacgtattaccttagttacgtacgttcggtcgtacggtccggtacgacgggaaccgtaggtcgtaacgtactacggtaacgtacggtacggttaggtacgttacgccgtaacg

SEQ ID NO: 279232 - DNA, 711 bp, Homo sapiens
  misc_feature: GYAE6OF02HMA5E.19.71.G05.1.454.CMB.1.raw
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (453)..(453): a, c, t, g, unknown or other
  misc_feature (453)..(453): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatcgaccagtctcagactcctggctgtgtctcgtgggcgaggcgggccacatcaacgtgacaagtccacgaccaactaattacttttaanactacgttaccaaacaatacgaaaactagtactcgttaggtaaccngacagaagaccaacggacacgtacctacgtacggctacgctacgtaactttacgagggacacgttaccgtaacccgggaacgttcccggggtacctaggaacccgtattaccgagggttcgacggtacggtcgggtacgtacggggactaacgttcgtttanaccttacctaacgaaccctaagttaccgaactaacgactacccgtgaccgtaggaccgtaagtaacgtagttggaccgttagttaacgtttatagtttaacgaacgaaaattaagttaagtttaagttaacgttacgtttaacgtcgggtaacgttccggaaacgggttaaacgggccggtttaaaggtcggtaaaattaaccgttaacggtaaacgtaacggtaaccgttgggtaaacggtcctaagggtaaacccc

SEQ ID NO: 279233 - DNA, 682 bp, Homo sapiens
  misc_feature: GYAE6OF02HT8KV.19.71.G05.1.454.CMB.1.raw
  modified_base (245)..(245): a, c, t, g, unknown or other
  misc_feature (245)..(245): n is a, c, g, or t
  modified_base (475)..(475): a, c, t, g, unknown or other
  misc_feature (475)..(475): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcccgtggctgtcgtctcgtgggcgaggcgggccacactcaactcgacagtccagccactacttcttttanactacgttaccaacaactagaaaacttacttacgtacgttacggtaccagacaagaacgaccgaacggaccacgcctaccgtaggcgtcgctactacgtttacgtggactacgtccgtaaccgggaacgtcccggggtacctacggaccgtacgtacgagtacggcgtacgggtcgggtcggtacggacgtagtactttccactcgtacctacatacgacgcacgtccgngacgacggactaggaagtagttcggtcgtacgttaagttttaattacgttacgtactaaacgtaattaactttaactttaacgttacgttacggtacggttaaccgggttacgtaaccgggtaacgggtaaccggtaaggggttaacgtacgttaacgtacgtaacggtaaccggtaacgttacggtacggtaccgttacgaacccg

SEQ ID NO: 279234 - DNA, 253 bp, Homo sapiens
  misc_feature: GYAE6OF02F593D.19.71.G05.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (225)..(227): a, c, t, g, unknown or other
  misc_feature (225)..(227): n is a, c, g, or t
  modified_base (229)..(253): a, c, t, g, unknown or other
  misc_feature (229)..(253): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagacctccctggctgtgtctcgtgggacgnggcgggctggcgaaggcgnagtgnnncnnnnnnnnnnnnnnnnnnnnnnnnn

SEQ ID NO: 279235 - DNA, 776 bp, Homo sapiens
  misc_feature: GYAE6OF02JHFER.19.71.G05.1.454.CMB.1.raw
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggacnggcgggccaccatacgactgcagtccagccacattcttttanacacgttccaacatagaaaaccttctagcttggtaccagacagtacgacctacggacacgccttacgagtctgacctcgtaactttacgngggacctacgtcccggtaaccccggggtaaggttcccccggggttaccctacggtaacccgtactttccgaaggttcggaccgtacgggtcgggttcgagggtaccaaggttactttaccgtaaccgtcctaccgaccttactacggtaccgcgtaccgtaccggtcgaccggtaggtacccggttaaggaaactacgggtttagggttacgggtacctttaaacgggttttttaacgttacgtttaccgaaacccggtaaaactttaagggtttaaaccttttttaacgttaaaaccgttttccgttaccgggttaaccgggttaccgggtttaccgggaaccgggtaaacccgggttaacggaacgggtttactaaccgttttaacgaaccggtaacgggtaccgttaaccggttcgggtacccggtgtacccggttaacccgg

SEQ ID NO: 279236 - DNA, 750 bp, Homo sapiens
  misc_feature: GYAE6OF02IMYNC.19.71.G05.1.454.CMB.1.raw
tcagtactctcgtgcacgaccggtgctcgatttagtgtcgtcgcaagagagagggggagagtctgctgaattctggctgaccgagggcagtcaccagagctccagacaatgtctgtctccttctcttcttcctgcccgtgctgggcctcccacgaaggtcgtcctgtcacaagtacagctgcagcagtcaggtccaggctggtgacgccctgcacgaccctctcgctcacctgtcgccatccgtccgggacgacgacgtcgtctacgcgactagttgttgtcgttcgcgacgtggtcgacggcgtacgtcccgacgtacgtagtacggtacgtagaggtcggtcgtaggggaacggacgtaacgtttacgtttacgtactcggggggggggggttacctaaaccggtaacggtaaggtaaacgttaaacttaaacgtttaacgtacgtacctaacccgtaacgtttacgtttaggtttacggtaacggtacggttaccgtaacgtacgtaactaaccgtaccgtaaacgtaacgaacgtaacctaacgtaaccgtaaaccgtaaccgttaaccgttacccgttacccgtacgtaccgtaccgtaccgttaccgttaccgttacgttacgttaccgtacccggtacccggtaacgggtaacggttacgggttaacggttaacgttaacgtttaacggttacggtaacgggtaaccggtaacccggtaaccccgtaaccgtaaccgtaaccg

SEQ ID NO: 279237 - DNA, 637 bp, Homo sapiens
  misc_feature: GYAE6OF02G9N7F.19.71.G05.1.454.CMB.1.raw
  modified_base (241)..(241): a, c, t, g, unknown or other
  misc_feature (241)..(241): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgccacgggacatcgtgatgacccagtctccagacctccctggctgtgtctcgtgggcgaggccgggccaccatcaactgcaagtccagccaacaatctttanactagttaccaacaatagaaaactacttaagcttaggtaccagcagagaccaacggacacgtccctaccgtacggctgacctctactttacgcgggtacacgtccgtacccgggaacgtcccggggtccctagaccgtattcgaggtcggacgtaggcgggtacgtagggacaggtactttacgactcctaccacctagacacgacacgtcctcggaccacggtactaggaacgagttcggtagtacgttaaggttttaattacgttacgtaactaaattaaagtttaatttaattaacgtttacgttacgggttacggtacggtttaccggacggtaacgggtaaccgaagggtcgtaatacgtagaacgtacgtaacgtggtcggactggtacc

SEQ ID NO: 279238 - DNA, 730 bp, Homo sapiens
  misc_feature: GYAE6OF02G6RSR.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgagccggccaccatcaactgacaacgtccacgccctaanacttctttaactacgacttacccaaataataacgaaaacttactttagccgtttacggaaccagaccaaggtacgaaccgaaggtaaccaccggaccccttccggtaggcctgtcccttacgtaattttaaccggcgggaactaccgtaccgggtaaccccgggaacggttccccggggtaccctacggaccgttacttcgaagggtcgcctaggggtccgggtacggcggaaccttaggtaccctttccacgtcctaacccgtaacacgttaccaaggtcccgtaacggtcccgtaagtcggaaacggtccgttaagagttaccggttgggttacgtacgtttatttaacggttataccgtaataaacgtttattaactttacgtttagtaacccgtttcgggtaacgtccggttaacggaccgtaaacgggtcgttaagggacgtaacgtactaacgaagttccgtaagcggtacggtataccgaccg

SEQ ID NO: 279239 - DNA, 636 bp, Homo sapiens
  misc_feature: GYAE6OF02FWGHZ.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaacctacttagtcttaggtaccagcaagagaccaggacagtcctcctaggctcgcttcatttacgtgggacatcgtaacccgggtagtcccggggtaccctagacccgagttacagttcggcgacggtcgggttactgggactagtatttcctactctaccaccatcgaacgcagtcctagaccgtaggcctagaagtgtagtcggtacttaggttttattacttagttaaccgtaaactaaagtttacgtttaatttacgttaaccgttcgggttacggttaaccgggttaccggtaacccggtaaacggggttacccgtaaagggttacggtaacgttacgttaccggtaacggtacccgtaacgttacggg

SEQ ID NO: 279240 - DNA, 699 bp, Homo sapiens
  misc_feature: GYAE6OF02FUAIH.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctcgtgggcgagcggccaccatcaactgacaacgtccagcccataacttcttttaanacgtacgttacccaactaaataacgaaaacttacttagcctttacggtaaccagctaagacgtaaccgaggaaccacgccctacgtacggctgccttactactttacgtcggacacgtaccggtacccgggaacgttcccgggggtacctcggaccgtacttcgacggtcggcgacgggtcggtcgtagggactagtacgtttaccacgttactaccaacctatccgaacgcgacgccgttacgacgtacggtcgtacgtaagtacgtacggttacgggtacctttaaggttttaactttacgttacgtaacgtaaccttaaatttaatttaaacgtttaactttacgtttcggttcggttaacggttcccggaacgtaacggggtaaccgtaagggtggtaacgttaagtaccgtaacggtaaccggtaacgtaggtacggtactcggttaacc

SEQ ID NO: 279241 - DNA, 689 bp, Homo sapiens
  misc_feature: GYAE6OF02FIP8D.19.71.G05.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaacgtccagaccacaattcttttaanactacgttccaacaatagaaaactacttagcttaggaccagcagagaccaggacagcctctaggctgctcatttacgngggctacgtcgtaacccgggaacttcccggggtccctagacccgtattaccgaggttcggacgacgggtccggggttacgtacggggactaacggtttactttaccgacccgttccttaccgaaccctagtacccgaaggtccaacggtcccgttgaccggtaacgggtccgttagaaacgttagtcggtagggtaccttaagtttttagttaacttcggtaactaaacttaaagtttaatttaactttacttacggttcggttacgggtaacccgtttccgggaaccggttaaaggggtaaccctaagggttaggtaaccgttagtaccgaagggtaccgtaacgttgggtaccgttcgtacgacccg

SEQ ID NO: 279242 - DNA, 727 bp, Homo sapiens
  misc_feature: GYAE6OF02GIUHZ.19.71.G05.1.454.CMB.1.raw
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgcaagtccacgccactaattcttttanactagttaccaaacaatagaaaacttacttagcttcggtaaccagacaagagaccaggacagcctcaggctgcttacagtttacncgggctaactccgtaacccgggaacgttcccggggtccctagacccgtattcgtaggtcggtcgaaggtccgggggtctacggggaacgtagtactttcctacctcctaccaaccctagttaccgacgacgacgtcccgtacggaccgaggtaccgttaaggaaacggtattacggggtagtacgtttaagtttttaacgtttaaacgtttcggttaaccaaaacgtttaaatttaaacgtttttaatttaaacttaccgttttacggggttacggttaacccgggtttaccggggaaccggtaaaacgggggtaacccgttaaaggggttacggtaaagttaacgttacggaaacggtaccggtaaaccggttgggtaccggttacggtgtaaccccg

SEQ ID NO: 279243 - DNA, 759 bp, Homo sapiens
  misc_feature: GYAE6OF02H7KV0.19.71.G05.1.454.CMB.1.raw
  modified_base (250)..(250): a, c, t, g, unknown or other
  misc_feature (250)..(250): n is a, c, g, or t
  modified_base (379)..(379): a, c, t, g, unknown or other
  misc_feature (379)..(379): n is a, c, g, or t
  modified_base (464)..(464): a, c, t, g, unknown or other
  misc_feature (464)..(464): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggccaccatcaactgacaagtccacgccaactaatttcttttaanacgtacgtttacccaaaacaattaacgaaaaaccttactttaaggaccgtttagggaacccaagtcaagacgaaccgaaggaccacgtcccgttacccgtagggacctgtccttactaagttttaccgngggactaacttacccggtacccgggaacgtttccccggggtcccttaggaccttagttacgacggtcggacgacggtcggggttnacggggtactaaggtcttttaccgacttccaccgtaccgacttaccgacggtccaacgtcccgacggaccgtagggacttaacggaaggtagttacggtcgtacgttaaagttttgttaatttacgaccttaaaacgttaatttaacgttttaactttaacgttaaccgttacgggttacgggttaccgtttaccggggtaaccgtaaacggggtaccgttaaacgggttacgtaacgttaactcggtaaaccggtaaccgtaacggttccggtaacggtccgttacgtaacccg

SEQ ID NO: 279244 - DNA, 655 bp, Homo sapiens
  misc_feature: GYAE6OF02F17I2.19.71.G05.1.454.CMB.1.raw
  modified_base (502)..(502): a, c, t, g, unknown or other
  misc_feature (502)..(502): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccgacggggacatcgtgatcgacccagtctccagacctcccgtggctgtcgtctcgtcgggcgacggccgggcccaccacgtcaactgacaacgtccacgccaactaattactttaataccgtacgttaccaaactaaatacgaaaacttacgttagtaccgttacgtaacccagacaaggacgaaccgaggaacacgacctaccgtaggctcgtacgtcttagttacgcggactacgttaccgtaaccgggaaccgtcccgggtccgtacgaccgtacttcgagtacggacacgggcggtacgaggtacagtacttacgactcgtacacgacgtacacgtcgacncgtacgacgagaccgttaagaagtaggttcgtacggtaccgttaagtttacgttaagttcgtaaacgtaacttaaagtttattaagttacgttacttacggtagtaccggtaacggtacgaacggtacgaaggtacgtacgtacgtagtaacg

SEQ ID NO: 279245 - DNA, 753 bp, Homo sapiens
  misc_feature: GYAE6OF02IZ5D9.19.71.G05.1.454.CMB.1.raw
  modified_base (610)..(610): a, c, t, g, unknown or other
  misc_feature (610)..(610): n is a, c, g, or t
tcagtactctcgtgcacgaccggtgctcgatttagtgtcgtcgcaagagagagggggtcaggctggaactgaggagcaggcagggggcagcaagatggtgtgcagacccaggtcttcatttctctgttgctctggatctctggtcgcccgacggggacatcgtgactacgacccagtcctccacgacctcccgtggctggtcgttctcggtgggccgaggccgggaccaccgtactaccgaacgtcgacaacgtccacgaccaactaacttcgttttaactactacgttaccaaactaattaacgtaaaaccttacgttaacgtaccgtttacggtaaccaggtaccaacggaaccggaaccctaacgggacctaccggtaccccttaccgtaacggtccttcggaccttacttaacgtttacggcggtacctacttacccgtacggaccggtaacggtaaaccggttccggggtacccctacggtaccggtaacgggtcccgggacgtacggggtccgtgggtaacggacgtacgtacgtttaccaaccgttcctaaccacgtaccgtacaccggtacgactaccgtcgaccgggtagaccgtagaacncggttaccggtcggttaacgttctttaacgtagtccgttaacgataacgttacttttcgttttaactcgtaccggtttcggaacgttccggaacggtccggaacggttggacggtaagtacgtaccaaggtaccttggtaagg

SEQ ID NO: 279246 - DNA, 668 bp, Homo sapiens
  misc_feature: GYAE6OF02IOG0F.19.71.G05.1.454.CMB.1.raw
  modified_base (167)..(167): a, c, t, g, unknown or other
  misc_feature (167)..(167): n is a, c, g, or t
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagtactctcgtgcacgaccggtgctcgatttagtgtcgtcgcaagagagagggggaggtacaacaggcaggcaggggcagcaagatggtgttgcagacccaggtcttcacttctctgttgctctggatctctggtcgcccgacgggacatcgtagatcgaacccngtctccagcctcccnggctgtgtccttcgnggcgtaggcggtccacntcaactgacagtccagccactattctttanaactacgtacaaatactaacgaaactagttacgatttacggaacagacgagacgacgagacgacgtcctacgtacgcgtcactgttaaacttcgaggtactacgtaccgaaccggtacgtccggggtcctaggaccacgttcgagtacggtccgaaggtccgtcgtaaggaccgtgttacgtcaccgtctaactaccgtaataccggataccgtacgcctcggtacgacggtacgagaacgttacgtggtacgtagttaacgttacttaggtaccttaacaaccgtttaaattgtttaaattacccttaggttaaccgtacggttaacggtacgtaaccgggtaacggttaaacccgtaagggtacgtaagttaaccgtacgtaacgtaccgtaacgtacgggttaccgtagtaacccggtaac

SEQ ID NO: 279247 - DNA, 750 bp, Homo sapiens
  misc_feature: GYAE6OF02JL5PP.19.71.G05.1.454.CMB.1.raw
  modified_base (177)..(177): a, c, t, g, unknown or other
  misc_feature (177)..(177): n is a, c, g, or t
  modified_base (387)..(387): a, c, t, g, unknown or other
  misc_feature (387)..(387): n is a, c, g, or t
  modified_base (741)..(741): a, c, t, g, unknown or other
  misc_feature (741)..(741): n is a, c, g, or t
tcagtactctcgtgcacgaccggtgctcgatttagtgtcgtcgcaagagagagggggagagtctgctgattctggctgacagggcagtcaccagagctccagacaatgtctgtctcctcttcttcttcctgccgtgcgtcggcctcccactaaggtcgtcctgtacacaagtacganctgcagcagttaccaggtcagggctggtacagccctgaccatacccctgtcgcttcacctgtcgccagtcctcggggaccagacgttcgccgtacggacgaaccgttagtcggttgtaccgtttgggaccttaacggtcggggttaaccacggggttaccaccggttaccccccaaggttaccgggaaggtaacgggtcttaaaccgggnggttaccgggtaggttaaccggggaaagtaccgtaacttttagttaccaaggttcttaaccccggaaaagtccgggttaaagttaaaccgtaaaggttaaaacttttcggtacgaacccgtaacctacgttacgttacggttttaacggtaacgggttacggtaacgtaccgttaggaacctaaacgtacgtaaacgtacgtaacaaacgaccgttaacgacgtaaaccgtcgttacccttaccggtctacgtacgtaacgttaccgtaaccgttccttaggtccgtaccgtccggaacgggtaccgtaccgggttagtattaccgtttagcggttaacgcggtacccgacccnttacggaac

SEQ ID NO: 279248 - DNA, 678 bp, Homo sapiens
  misc_feature: GYAE6OF02INAL1.19.71.G05.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagacctccctggctgtgtctcgtgggcgagcgggccacgatacgacgtnactagtcancanatcttanacacgtacaactagtaacgtaaactacttacggactttacggacacgcgtaacgacgaaccgtaacggacctacggtccctaccggaggtccgtaccgtacttaacgtactttaacggccggtactaaccgttaccggtaccggtaaccgtcccggggtacctaacggtacctcgtaacggcgtacggtaacgtcggtaccgggttagtccgaacgttacggttactacgtacctactaccgaactacgtacgacgacgtcacgcgaccgtagacgtgaacgtggtacgtgtacttcgttaagttactacgtaacttaacgtaatttaacgtaactttacgttacgttaccgtaccggttacgtaccgaacgtaacggtaaccggtaggtagtaacgacgtaacgacgtaccgtaggtacgtacgtcgtaccgtaccg

SEQ ID NO: 279249 - DNA, 682 bp, Homo sapiens
  misc_feature: GYAE6OF02HMG72.19.71.G05.1.454.CMB.1.raw
  modified_base (246)..(246): a, c, t, g, unknown or other
  misc_feature (246)..(246): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatcgacccagtctccagacctccctggctgtgtctcgtggcgagcggccaccatcaactgacaacgtccacgaccactaattcttttanacagttaccaactaatacgaaaacttacttagtacttacggtaccagacaagacgaaccaggacacgcctaccgtaggctgctctagtttacgtcgggactacgtaccgtaaccgggtaaccgtccggggtccctacggtaccgtattaccgtaggtcggacgtacgggtccggtacgtacgggaactagtacttttccacctcgtaccaccgtaatactacgactacgtccgtacgacgttacggacgttaaggtaacgtgttacggtaggtacttaaggtttattacgttagttaacaacgttaattaagtttacttaactttacgttacggttacggtaaccggtttaccggaaccggttaacgggtaaccggtacggtagtaacgttacgtacgtaacggtacgtaacgttggaccggtactcgtaacccgg

SEQ ID NO: 279250 - DNA, 643 bp, Homo sapiens
  misc_feature: GYAE6OF02JMNXS.19.71.G05.1.454.CMB.1.raw
  modified_base (250)..(250): a, c, t, g, unknown or other
  misc_feature (250)..(250): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagtactctcgtgcacgaccggtgctcgatttagtgtcgtcgcaagagagagggggggagggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaacgtccacgcccaactaacttcctttttanaacgtacgttaccaaaccaaatacgaaaacttaacttagctttacggtaccagcaagacgaccaacggacacgcctaccgtacggactcgcctcgtactttacgtcgggcacttccgtaacccggggaacgtcccggggtccctacggaccgtattcgagtggcaggccgggtcgtcggacgagtactttaccncctctaccaccagtaccgacncgacgtccgtcgcgtacggccgttaggaacgtagtcggtaggtccgtttaagttttacgttaatttcgactaaactaagtttaatttagttaactttcttacggttgtaccggttcggaaccgtaacgggtaccggaaggtcggaattagacctagacgtactaggtcgtcgtgtacc

SEQ ID NO: 279251 - DNA, 986 bp, Homo sapiens
  misc_feature: GYAE6OF02GCUPU.19.71.G05.1.454.CMB.1.raw
  modified_base (252)..(252): a, c, t, g, unknown or other
  misc_feature (252)..(252): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtcctccagactcccgtggctgtgtctcgtgggcgagcgggccacgatacaacgtcgactaacgtccacgccacgtaattctttaanaccgtaacgttaccaaacgtaatacggtaaaaccttacttaggtaccgtttacgggtaaccctaaggccgaaggtaaccggaacccgtaaggaaccgtaccggtaccccttaccgttaacggggcccttggtaccgtttacgttaacgttttaaccggcggggtcctaaccgttaccccgggtaaaccccggggtaacggtttcccccggggggtacccttacgggtaaccgtaacgtttaccggtaacggttcgggtaccgtaacggggttccggggtttacgtaccggggggtaacctaacgggttttaacttttcccgtaaccggtttacccgttaacccggtaacctaaccggtttaccgtaaacgacccggttaaaccgggttcccgttacggggtaacccggtaccggggttaaccgttaaacgggttaaaccggtaacggttttacggggaacgggtttaccggttttaaaaccggttttttaagttttaaaccggtttaacccggtttaacccgtaaaaaccgtttaatttaaaccgttttttaaacggtttaaaccgtttacccggttttaacgggttaccgggttaacccggttttaccggggaaacccggttaacggggtttaaacccgggtaaggggttaaccggttaaccgttaagggtttaccccaaacgggtttaccggttaaaccggttgggtacccgggttaccgtacggttacccg

SEQ ID NO: 279252 - DNA, 779 bp, Homo sapiens
  misc_feature: GYAE6OF02IX79F.19.71.G05.1.454.CMB.1.raw
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
tcagtactctcgtgcacgaccggtgctcgatttagtgtcgtcgcaagagagagggggggaggtacaacaggcaggcagggggcagcaagatggtgttgcagacccaggtcttcatttctctgttgctctggatctcgtggtcgcccgacggggacatcgtgatcgacccagtcctccagacctccgtggctggtgtctcgtgggcgaggcggaccacatcaactgacaacgtccacgccaactaacttcttttaanactacgttaccaaactaataacgaaaacttacttagtcttacggtaaccagacaaggacgaaccgaaggaccgacgtccctcgtacggctacgtctacttaactttcggnggacctacgttaaccggtacccggggtaacggtccccggggtaccctacggaacccgttacgttaccggagggtcggacgtacgggtccgggttacgtacgggaactagtccgtttacgtaccgtacctaccgaacctagtaccgacgccctacgtcccgtagccgtacggacgtaggtaacggtacgttgggtacggtttacttaaaggtttttcttttaaggttaccgttaaaccgtaaagttttaaacgttaactttttttaacgtttaaacgttttccgggtttaaccgggttaacgggttacccgggttacggaaccgggtaaacgggtaaccggtaaggttacgggtaacctaggttaaccgaacggtaaccggtaacggttcggtacgggtacgttaccgtaaccg

SEQ ID NO: 279253 - DNA, 875 bp, Homo sapiens
  misc_feature: GYAE6OF02IEKA6.19.71.G05.1.454.CMB.1.raw
  modified_base (251)..(251): a, c, t, g, unknown or other
  misc_feature (251)..(251): n is a, c, g, or t
  modified_base (348)..(348): a, c, t, g, unknown or other
  misc_feature (348)..(348): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtcgtctcgtgggcgaggcgggccaccatacactgacaacgtccacgaccaactaattcttttanactacgttaccaaactaataagtaaaacctacttagtcttacggtaaccagcaagacgacccgaggacacgcctccgtaggctgctctagtttccgnggactacgtacccggtaaccgggtaaccgttcccggggtcctacggtacccgtacgttaccgaggtcggacggtacgggtccggggttacgtacggggaaccgttaacggttaacttttcccgtaacccgttacctacccgtaaacccgttacgttaaccgacgtccgtaaccggtcccgttaggacccgtaacgggtacgttaacgggaacgtacgggtttaacggtcgggttaacgttttaacgtttttaacgtttccgttaaacgttaaaccgtaaaacctttaaagtttttaaccgtttttaaacgtttaaccgttttaaccggtttacggggtttaaccccgggggtttaacccgggtttaccccggaaaaccgggggttaaacccggggtaaaccgggggtttaaacgggttaaccggggtttaaaactttaaccgggttaaacccggtaaccggggttaaacccggtttaaaaccgggtttcggggtaacccgggttcccgttaaacggttaacccccgg

SEQ ID NO: 279254 - DNA, 795 bp, Homo sapiens
  misc_feature: GYAE6OF02G8PYM.19.71.G05.1.454.CMB.1.raw
  modified_base (141)..(141): a, c, t, g, unknown or other
  misc_feature (141)..(141): n is a, c, g, or t
tcagtactctcgtgcacgaccggtgctcgatttagtgtcgtcgcaagagagaggggggaggtacaacaggcaggcaggggcagcaagatggtgttgcagacccaggtacttcattttctctgttgctctggatctctggtncccgaggggacagtcgtgatcgacccagtctccagactcccgtgctgtgtctcgtgggcgaggcgggccaccatccactgcagtccagcccaactaacgttcttttacacctacgtttacccaaactaagtacgtaaaaccttaccttagtaccgtttacgggtaacccaacggtacgaaggaaccgaacccgaacgggaaccctaccggtccccttacccggtacgggtccttcggcctttaaccgtaacgtttttaccggcgggtacctaacgttaccccgggtaaaaccccggggttacggttcccccgggggttaccctacgggtaacccggttagtttccggaaggttcgggaccctacgggggttaccgggtacgtaggggaacctacggtttacttttaccgacccgtacttacccaaccgtactaccgaagtaccgacgtccttacggaccgtaaccggtacgttaaggacgttcggttaggtcgtacgtttaagtttactttagttacgttaactaaacttaatttagtttaactttacgtttacgttacggttagtaccggttacggaaccggtaagggtaccgtaagggttagtagttaactacggacgttaacggtacggttcggtaggttccgacgtaccg

SEQ ID NO: 279255 - DNA, 738 bp, Homo sapiens
  misc_feature: GYAE6OF02HJBLX.19.71.G05.1.454.CMB.1.raw
  modified_base (266)..(266): a, c, t, g, unknown or other
  misc_feature (266)..(266): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacagtcgtgatcgacccagtctccagtacctccctggtctgtagtctcgtagggcgacggccgggaccaaccgatcaacgtgactaacgtccaagcccaaataacttacttttaanactaacgttaccaaaataataagtaaaacttacttacgtcgttacggtaccagacaagacgaaccaggtacacggtccttaccggtacggcctacgtctactaacgttttcggacggtactaacggttaccccggtaaacccggggtaacgtttccccgggggacccttacgggtaacccgttattacggaacgggttcggaaccgtaggggtccggtaaccggtggggaactaacgttactttccgaaccttcgtaccaaccgtattaccgacgtactccggtcgtacggaccgtaggaccgtaggtaaacgtgtagggtacgttacttaaggttttatacgtttacaacgtaaactaacgttatttaacgttaccttacggttacggtaacggttaccggttacggaacggtaacggaacgtacggtaagtaatacgtacgaggtaacgtacggtagtcgacgtacgtcg

SEQ ID NO: 279256 - DNA, 668 bp, Homo sapiens
  misc_feature: GYAE6OF02GW1DF.19.71.G05.1.454.CMB.1.raw
  modified_base (332)..(332): a, c, t, g, unknown or other
  misc_feature (332)..(332): n is a, c, g, or t
  modified_base (394)..(394): a, c, t, g, unknown or other
  misc_feature (394)..(394): n is a, c, g, or t
  modified_base (457)..(457): a, c, t, g, unknown or other
  misc_feature (457)..(457): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccgatacgaactgacaacgtccagccacaattctttatacacgttaccaacaactagaaaaaccttacttagcttacggtaaccagtcaagtacgacctaggacacgcctccgtaggctgacctntactttacgcgggactaactccggtaacccgggtaagttcccggggtaccctggaacccgtnttcgacggtgcgtacggcggttcgagggacacggtactttccgacttccgtacaccgagtacncgaccgtacgtaccctaggccgtacggaccgtaaggaagtacgttgggacgtacgttaaagttttcttagtacgttaccgtaaataatttagtttaagttacttacgtttacggggtactaaccgggttccgaacggaacgggtaacctaagggtataaccgttaacggtacgaaccggtactaacgttaggtacggtacctagtaacccg

SEQ ID NO: 279257 - DNA, 598 bp, Homo sapiens
  misc_feature: GYAE6OF02H1UKT.19.71.G05.1.454.CMB.1.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccacatcaactgcaagtccagccanaattctttanacagttcaacaatagaaaacttcttagcttaggtacagcagacgaccaggacagcctcctaggctgctntatttacgnggctatccgtacccgggaactccggggtcctggaccgtattcgagtggcacggtcgggtcgtgggaactagtcgttttaccacgttactaccgaacctacgttcacgccaacggtcctggcgtagcgttaggaacgtgttcggtgtaaccttagttttaattaggttacgtaactaaacgtaatttatttattacgttacgttcggtagtaccgttccggacgtaacgggaaccgtagggttgaattagacgacggtaaccgtaagtggtacggctgtaacccg

SEQ ID NO: 279258 - DNA, 842 bp, Homo sapiens
  misc_feature: GYAE6OF02GDC96.19.71.G05.1.454.CMB.1.raw
  modified_base (234)..(234): a, c, t, g, unknown or other
  misc_feature (234)..(234): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctcagactcctggctgtgtctctgggcgagcgggccacatcactgcaagtccagccactaattctttanacacgttccaaactaatacgaaaacttacttagtcctttaggtaacctagacaagtaacgaacccaaggaccacgtccctacctaagggcttcggaccttctaaatttttaccgcggggtacctacgttacccggtaaccccggggtaaagttccccgggggttaccctacgggtaacccggtatttccggaacggttcgggtaacgtaacgggtcccggggttacgttacgggggaacctaggtttacgtttttcccaaaccgttccttacccgtaaacccgtaattacccgtaacggtaccaacggttaccccgtacggtaaccggtacggaccgtttaaagggaaaccgttaagggttcgggttacggtacccgttttaaagggttttaaacttttaacggttaacggttaacccttaaaaagttaaacgttttaactttttaaacggttttaacttaacccggttttacgggtaccgggttaaccgggtttacccgggaacccggtaaaaccggggtacccgttaaagggttacgggtaacgtttacgtaaccggtaacggtaaccggttaacggtacgggttacggttaccgtaccggtaacc

SEQ ID NO: 279259 - DNA, 779 bp, Homo sapiens
  misc_feature: GYAE6OF02JJ4I4.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccaccatcgaacgtcgactaacgtccacgaccaactaacttctttttaactaactacgttaacccaaactaaacgtaacggtaaaaaccttacctttaaggcctttacggggtaaccccaggaccgaaggtaacggaacccctaacggggtaccctaacgtccccttacccggtaagggtcccgtaggtcccttacgttaaccgtttttacggacggggtacctaacttaccccgggttaaacccggggtaaccgttcccccgggggttaccctaacgggtaccccgtaagtttccgaagggtcggacgtacggggtccgggtacgtaggggtacctaagtacttttccgacgtactaccgacctaactcgaacgcgtacgtctcggacgtacggtacgtacgaagtacgtcggtagtcgtagtttaacgttagttacgtacgtaaactaaagtttacttaattttaccgttacgttcgggttacggttaccggttcggtaacggaacggggtaaccggtaggtaacggtagtaacgtacgtagggtaacgtacggttaggacggttcacgtaaccg

SEQ ID NO: 279260 - DNA, 698 bp, Homo sapiens
  misc_feature: GYAE6OF02JZ2TE.19.71.G05.1.454.CMB.1.raw
  modified_base (123)..(123): a, c, t, g, unknown or other
  misc_feature (123)..(123): n is a, c, g, or t
  modified_base (140)..(140): a, c, t, g, unknown or other
  misc_feature (140)..(140): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttcnctgttgctctggatctntggtcgcccgacgggactagtcgtgatcgacccagtctccagactccctggctgtagtctcgtgggcgaggccgggaccaccacttacgaactcgacaacgttccacggacctaacctaatttacctttttaactaaccgtacggtttacccaaaccgtaaaattacgtaaaaaccgttacctttaagccggtttacggtaccgtagaccgtaaggacgaccgacggtacacgtccctcgtacggactcgtcgtacttacgttacgtcggctacgtccgtaaccgggtacgtccgggttccacgggtaccgtacgtttacgacggttcgacgacggtcggggtctacgggtacagttacttacgacttccgactaccgagtcagtccngccgttcgacnggtactgacgtatacggtcgtactagtttacgttatagtaacaacctagtatttaacgttatacggttcgttacggggtaactacccggttaaggaaaccgggttactaaaggggtacgttaacgttaccgtaaggaccggttaaaccgtacgttacgg

SEQ ID NO: 279261 - DNA, 661 bp, Homo sapiens
  misc_feature: GYAE6OF02FT77S.19.71.G05.1.454.CMB.1.raw
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
tcagtactctcgtgcacgaccggtgctcgatttagtgtcgtcgcaagagagaggggcagagtctgctgaattctggctgaccagggcagtcaccagagctccagacaatgtctgtctccttcctcttcttcctgcccgtgctgggcctcccacaaggtgtcctgtcacaagtacagctgcagctagtcaggtccaggactggtgaagccctgcagacccctctcgctcaccctgtcgccctatccgtccggggacagacgtcgctagcgaactaggtgttncttggcacgttgggtcaggcacgtcccagtcgagagtctaggacgtgggcgtagggaacgganattntttacagtcgtaccaagtacgtgggaaactaacgtaaacttacgtcgtccaacgtaacttccgtagtttacggtaacgaacgttacggtaacgttacgtaaacaagttaaccaaaccggttaacgaacaaacgtactaacggaaaacgtaaccgtaagttaccctcccgttacgaccgtacgtaccgttaccgtaccttcgtacgtcgaacccgtacccggtacgggtaaccggtaccggggttagttaacgttaacgttaacggttcggtaacgggtaaaccggtaccggtacccccgtaaggttaacccgg

SEQ ID NO: 279262 - DNA, 735 bp, Homo sapiens
  misc_feature: GYAE6OF02H46A7.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctggcctcccacaaggtcgtcctgtcacaagtacagctgcagcagtcaggtccaggacgtggtagaacgccctcgcgacgacccctctccgcctctaccgtgtcgccagtccggtaccggggacaggagtccgacgtacgcgactaggttgttgcgttggcgtacggtggtcgaggcaccgtcccagtcggagtaggtcgtaaggaggtgggacggtaggggaacgtacgtaatttacttacgacgttacgtaacccgaaacgtacggtaacggtaaactaaacgttaaacgtttaacgtacggtaccctaaaccgtagtttaccggttagggttaacggaaggttacggttaccggaaacgttacggaactaaacgtaaccggtaaacgttaacgaaccgaactaaacgtaaccggaaaaaccgtacccgttaaccggttaccctacccgtaggaccgtaacgtccgtaccggtacccttcgtacgtacccgtacccggttcccggtaacgggaccgttaacggggttacttaacggtttacgtacggtggtaaccgggtaaccgaaccccgggtaccctaacgaggtaacccg

SEQ ID NO: 279263 - DNA, 722 bp, Homo sapiens
  misc_feature: GYAE6OF02JSH8Y.19.71.G05.1.454.CMB.1.raw
  modified_base (166)..(166): a, c, t, g, unknown or other
  misc_feature (166)..(166): n is a, c, g, or t
  modified_base (259)..(259): a, c, t, g, unknown or other
  misc_feature (259)..(259): n is a, c, g, or t
  modified_base (311)..(311): a, c, t, g, unknown or other
  misc_feature (311)..(311): n is a, c, g, or t
  modified_base (690)..(690): a, c, t, g, unknown or other
  misc_feature (690)..(690): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgaggggacatcgtgatcgaacccngtcctccagacctcccgtggctgtgtctcgtcgggcgagccgggccaccagtacaactggacctaacgtccacgcccaataactttctttaanacgtacgttaccaaactaaatacgtaaaacttacgttagtcttaggtaaccngtacaagacgaccaaggacacgcccttaccgaggtcctacgccttacgtaacgtttacgcgggactacgttacccggtaacccgggtaggttccccgggtacctacggaaccttagttaccgagggttacggacgttacggggccgggttacgacggggtaaacctacggttaacttttccgaaccgttcctaacccgtaaccgtactaccgaacggtccgtaacggtccgtacggacgtagggtacgtagtaacggttaagtcgggtaacgtacgtttaagtttacttagttacgtaactaaacgtaatttaattacttaagttaccgtggttaaccggtacgtaccgtacggtaaggtaccgtaaggtgtaacgttntacgacgtaacgtcgtaggtcgtactgtaacc

SEQ ID NO: 279264 - DNA, 644 bp, Homo sapiens
  misc_feature: GYAE6OF02HLVXK.19.71.G05.1.454.CMB.1.raw
  modified_base (296)..(296): a, c, t, g, unknown or other
  misc_feature (296)..(296): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaagcccctcgcacgacccctctcgctccacctgtcgcctagtcgtccggggacagtagtcgctagcgactagtgttgcttggcacgtggtcnggcacgtcccagtcgagagtctagagtggcgtagggaaggactattattcaattcgtaccaacgtacgtagtaaatacaaattagtcgactaactatcgttagttaggtaaggtacgttacgtaccgtagaaacctaaactaccgtaaacgtacgaactaacgtaagtaccggaaaccgtaaccgtacgtttacccgtcccgtacacgaacgtccgtacggtaccttcgtcggtaccgtacccgtacccggtaagggtaacccggtaacgggttacgttaaacgttaccgtttaacgtacgggttaacgggaaaccggtacccgggaaccccgtaggtaacgtaaccg

SEQ ID NO: 279265 - DNA, 628 bp, Homo sapiens
  misc_feature: GYAE6OF02GVB6Q.19.71.G05.1.454.CMB.1.raw
  modified_base (615)..(615): a, c, t, g, unknown or other
  misc_feature (615)..(615): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtcgtctcgtgggacgaggccgggccacgactacgaactgacaacgtccagccaactacttctttaacactacgttaccaaataacagaaaacttacgttagtcgttaggaccagacaaggacaaccgaggacaacggcctaccgtaggcctacgtctaacgtatttacgagggctaagtccggtaacccgggtaggtccccggtccgtacgacgtatacgtaagggtccggaacgtagggtccggtacggtacggacaggttaccttacacgtccactacgtactcacgactcgcctagcgagacgacgtgacgttgagctttagttattatacgtactaaactagtactttatacgttctaggacgttccgtacggacgttaaggacgtaaggtaggtactagccgaacgttacgtctacgggtntacgtacgtaccg

SEQ ID NO: 279266 - DNA, 693 bp, Homo sapiens
  misc_feature: GYAE6OF02IE4KI.19.71.G05.1.454.CMB.1.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (340)..(340): a, c, t, g, unknown or other
  misc_feature (340)..(340): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctcccgtggctgtgtctcgtgggcgaggccggccaccatacaactgacagtccagccaactaattcttttaanactacgttaccaanaatacgaaaacttattacgcttaggtaccagacagacgaccgaggaccacgtcctaccgtaggctgctctatttacgnggctacgtaccgtaccgggtacgtcccggggtaccctggaccgtatcgaggtggaccgaggtccgggtctacggggactagttactttaccacttcctacgacctagtacgacgtccgacgtcctagcgtacgcttaaggaacgtgtcggtacgtagtttaaacgttttgttacgttacgtaactaaacttaagtttaactttaaacgttacgttacggttacggtaacgggttaccgtttacccgggaacccgggtaaacgggtaccggtaagggttaaccggtaacgttaccgtaaccggttaacggtaaccgttaaccggttcgggtaaccggtcccgtaagtaaccccg

SEQ ID NO: 279267 - DNA, 705 bp, Homo sapiens
  misc_feature: GYAE6OF02G35PG.19.71.G05.1.454.CMB.1.raw
  modified_base (246)..(246): a, c, t, g, unknown or other
  misc_feature (246)..(246): n is a, c, g, or t
  modified_base (354)..(354): a, c, t, g, unknown or other
  misc_feature (354)..(354): n is a, c, g, or t
  modified_base (462)..(462): a, c, t, g, unknown or other
  misc_feature (462)..(462): n is a, c, g, or t
  modified_base (499)..(499): a, c, t, g, unknown or other
  misc_feature (499)..(499): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcccgtggctgtcgtctcgtcgggcgaggccgggccacatcaactgacaacgtccagccactattctttanactacgttaccaataactagtaaaaccttcgttacgtcgtttacggaaccaggactaagaacgtaaccgaggaccacgcccttacgacggctcggctacttatttcgngggactacgttcccggaacccgggtaacgtcccggggtaccctaggacctacgttacgaggtcggaccgtaaggtccggttacgtaggggaacctacggttctttacnccgttacgaccaccgtactacgagaccgtggtacccncggacggtcgacgttaaggaacgtgtcggtacggtacgtttagtttaattacgtacgttaactaaacgttaattactttaacgttagttacgttacggttacggtacggtttaccgaaccggtaacgggtaacgtacggttacggtaacttaacgttaccgaacgggtaaccggtaggttacggtaggtaccgtaccgtaacccgg

SEQ ID NO: 279268 - DNA, 608 bp, Homo sapiens
  misc_feature: GYAE6OF02ILJNQ.19.71.G05.1.454.CMB.1.raw
  modified_base (344)..(344): a, c, t, g, unknown or other
  misc_feature (344)..(344): n is a, c, g, or t
  modified_base (438)..(438): a, c, t, g, unknown or other
  misc_feature (438)..(438): n is a, c, g, or t
  modified_base (488)..(488): a, c, t, g, unknown or other
  misc_feature (488)..(488): n is a, c, g, or t
  modified_base (554)..(554): a, c, t, g, unknown or other
  misc_feature (554)..(554): n is a, c, g, or t
  modified_base (572)..(572): a, c, t, g, unknown or other
  misc_feature (572)..(572): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcacgaccctctccgctccacctgtcgccactccgtaccgggacacggacgtcgactacgcgactaggtgttcgcgttcggcctacggtcggggtcgacggctaccggtccccagtcgagtaggtcgtagnggtggcgtagggacgactattacttcagtcgtaccaacgtacgtagtaaataactaaatagtcgactactagtctaggtagaagtcgtacgacngtaaccagtaccgaagtacgaacaatacacgaaagacccttagttacccnccgtagacctacgtccgtacgtaccttcgtagtcccgtaccggtcccggaaggtcggtaacggttntaacgttacgtttacggngtaacggaaccgacccggtaccctaggtaacctacc

SEQ ID NO: 279269 - DNA, 774 bp, Homo sapiens
  misc_feature: GYAE6OF02GZA7E.19.71.G05.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcctggctgtntctctgggcgagccggccacgatacaactcgcaagtccacgccacaattctttanactagtaccaacaataanaaaactcttacgtcttacggtacacgcaagacgaaccgagtacacgtccctacgtacggactgcctacgtatttaccggtggactaacgttacccggtaacccggggtaacgttccccggggtacccacggtaaccgttacttaccgtagggttccgggacgacgggttccggggtaccggtaggaaccgtacggtttaacttttaccccgaccgtttcaaccccgtaaccgtaacgttcgaaaccgggtacctaaccgggtcccctagggtacccgtacggtaaccggttggtaaacgttcggttcggggtacgttaaccgttttaagtttttaagttaacctttacgtaacccttaaaagtttaaacttttactttaagttttaaccttaacggtttccgggttaaccgggttaccggttacccgggtaaaccggtaccggggttaaacggtagggtaacgtattaacccggcgtaacggtaaccgtagttacggtcggtacgtacctaacg

SEQ ID NO: 279270 - DNA, 652 bp, Homo sapiens
  misc_feature: GYAE6OF02I5A1F.19.71.G05.1.454.CMB.1.raw
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
  modified_base (644)..(644): a, c, t, g, unknown or other
  misc_feature (644)..(644): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccggccaccgatcaactgacaagtccagccacaattcttttanacacgttaccaacaatacgaaaactcttagcttaggtaaccagcaagacgaaccaggacacgcctacgtaggctgctctagttacgnggctacgtccgtacccgggaacgtcccggggtccctgaccgtattcgagtcggacagggccgggttcgtacggggactacggtacttttaccgacgttctccaaccatacacgtacacgtcctcggccaggacttagagtcgttaggtacgtaccgttaggttttacttaagtttacgttaaccaaagttaatttaagttttaacgtttaacgttacctttacgggtcggttaaccggttccgaaccggtaacgggtaaccgtaagggtggtaactacgtacgtaacggtaccggtacgttaggcggttaccgngtaacccg

SEQ ID NO: 279271 - DNA, 597 bp, Homo sapiens
  misc_feature: GYAE6OF02HITYA.19.71.G05.1.454.CMB.1.raw
  modified_base (239)..(239): a, c, t, g, unknown or other
  misc_feature (239)..(239): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcaagtccagccactaattcttttanacacgttaccaaactaatacgaaaactacttagcttggtaaccagcagacgaccagacacgcctcgtaggctgctcatttacgnggcatccgtacccgggaagtcccggggtccctggaccgtattcgaggtcggcaggcggtcgtgggactagtactttcgactctacacctatcagtcacgtccgtgcgagctagacgagtcgtagtactagtttattaagttcgtaactaaacttaatttatttaacttacttacgttcgttacggtaccgttacggtaccggtaagggtaccggtaaggttaggtaacttacgtacgaacggtaacgtaacgttggtacgtacgtacgtaaccg

SEQ ID NO: 279272 - DNA, 821 bp, Homo sapiens
  misc_feature: GYAE6OF02JSH85.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgaccagtctccagacctccgtggctgtcgtctcgtggcgagcggaccaccgactcgaactcgacgtaacgtccgacacctaactactttacgtttacacgttacctaaccaaactaagtaaacgtaaaccttattaccgttacgtaaccgtaccgaacgacacgaacgaaccgaggaccgtaccgtccgttacgtacggtcacgtctaacgttacgttacgcggtactaccgtaccgggtaaccggtaccggtcccggtacgtaccgtaacgtcgtcggtacggtacggtacggtaccggtacgggtacggtaacgggtaccttaacggtttaccttaccgtaccgtaccctaacctacttaacgaccgtaacgccgttaacgtcgacgggtaccgtaacgggtagtacggtaacgttacgggtaacggttattaccggttttaaaggttttaacttaaccgggtttaaccaacgtttaaaaaccgttaagttttacctttaaacttacgggttaaccttacggggtttaaccggttaacccgtacgggtaaaaccggtaaccgggtaaacggtttaaacggtaacgggttaacctaacgggttaacggtaaccgtttaacggttaacgttccggggtaataccccggttagtaacccgg

SEQ ID NO: 279273 - DNA, 854 bp, Homo sapiens
  misc_feature: GYAE6OF02G5JV4.19.71.G05.1.454.CMB.1.raw
  modified_base (848)..(848): a, c, t, g, unknown or other
  misc_feature (848)..(848): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccgggccaccatcaactgcaacgtccacgccactaacttcttttaacactacgttaccaaactaataacgtaaaaaccttaccttaaggtccgtttacgggtaacccctaggccgaacggaacggaaccccgaagggacccacggtacccctttccgtaacgggccgttacggtaccttaccgttaaacgttttaccggtcggggtacctacgttaccccggttaaaccccgggggtaaaccggttcccccggggggttaccccgttaacggaacccggttaagtttaccggtaaggggttcggacggtacggggtccggggttacggttacgggggacgttaacggttaccttttaccgtaccgtttacctacccgtaaccctacgtccgaaccggtaccacggtcccgttaggaccgtacgggtacgttaacggaaacggttcgtacggtcggttaacgtttaagtttttacgttaagtttactaacctaaagtttaagtttaaaccttttaagtttaaccgtttaaccgtttcgggtacggtttaaccgggttaccgaaccggtaaacgggtacggttaaagggtacgtaacgttaacgtacgaaggttaaccggtaacgttacgggttacggtaccgttanaacccg

SEQ ID NO: 279274 - DNA, 654 bp, Homo sapiens
  misc_feature: GYAE6OF02F4YED.19.71.G05.1.454.CMB.1.raw
  modified_base (241)..(241): a, c, t, g, unknown or other
  misc_feature (241)..(241): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggccacatcaactgcaagtccagccactaattcttttaanactacgttccaacaatacgtaaaacttacttagcttggtaccagcagagaccaggacagcctcctaggctgctctatttacgtggcataccgtacccgggtaatccccggggtacctacggaccgtagttcaggtcggacgacggtcgggtcgtagggactaaggttacttttaccgactcctaccaacctagtccacgccgaacgtccgtagccgaggtacctaggaacgtcgtggtacgtacttaaggtttttattagttacgtaactaaacgttaagtttatttaaacgtttacttaacggtttcgttaacggtaccggttaccggacggtaaacgggtaccgtaaagggttcgaacttacgtacgaaggtaaccgtaaacggttcgggtacgggtacctacggtacccg

SEQ ID NO: 279275 - DNA, 956 bp, Homo sapiens
  misc_feature: GYAE6OF02I668N.19.71.G05.1.454.CMB.1.raw
  modified_base (122)..(122): a, c, t, g, unknown or other
  misc_feature (122)..(122): n is a, c, g, or t
tcagtactctcgtgcacgaccggtgctcgatttagtgtcgtcgcaagagagaggggggaggtacaacaggcaggcagggcagcaagatggtgttgcagacccaggtcttcatttctctgttnctctggatctctggtcgcccgacggggacagtcgtgatcgaccagtctccagacctcccgtggctgtcgtctcgtacgggcgacggtaccggccctaacgaactaccaaccgtcgtactaaaccggtcccaacggaccaacgttaaatttccttttaagacctacggttaaccaaacggtaataacgtaaaacttccttaagtccttaaggtaccagtaccgtaggaacgacccgtaaggaccgtaccgtccgtaacgtacggacgtcgacttactacgtttacggcggacttaaccgttccgggttaaccccggggacggtttaccccggggtacccgttacgtaaacccgggttcttccgggtaacgggtccggtaccgggaacggtttcccgggggtaaccgggttaacccgggggtaaccgttaaaggttttaccccggttttaaccgccccgttttaccggttaaacccctaaaccccgttaccggttaccggaaacccggttaccggttaccggttaccccggttaacggtccggaaccgggttttaaccaagggggttaaaccgtacccgggttaggggtttaaaccccgggttaacctttttaaagggtttttaacgtttaaccggttttaacggttaaaaccccttaacgttaaaacgttttaagtttttaccgtttaaaaccggtttaacggtttcgggttaaccgggtaaccgggtttacccgtaacgggtaaacccgggtttaaaggtaaggtacccgttaaacgtacgtaaccggttaaccgtaacggtaaccgtaggggtcccttacggtctaaacccgg

SEQ ID NO: 279276 - DNA, 689 bp, Homo sapiens
  misc_feature: GYAE6OF02FJLT3.19.71.G05.1.454.CMB.1.raw
  modified_base (338)..(338): a, c, t, g, unknown or other
  misc_feature (338)..(338): n is a, c, g, or t
  modified_base (652)..(652): a, c, t, g, unknown or other
  misc_feature (652)..(652): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagacctccctggctgtgtctctggggcgagcgggccacgatacgactcgactaaggtccagccacaattccttttaagtacagttacccaacaatagaaaactacgttagcttggtaccagctaaggagaccgaggacaggcctccgtaggctgctactatttacgngggtacagtacctaacccgggaacgtcccggggtccctaggtaccgattcgacggtcggaccgaggtccggggttacgtcggggaactaacggttactttccgtaaccgtccttaccgacccttacgtaccgtagggctacgaccgtgaccgacggtccgtagtaagtacgtttcggtcggtaacttagttttaagttaagttcgtaccgtaaaataactttaactttaatttacttaccgttacggttaacgggttaccggtttaccgggaccgtaaagggaacccgttaagggttacggaacttaacggtanaacggtaaccggtaacttcgggagtcgtacgtaaccg

SEQ ID NO: 279277 - DNA, 750 bp, Homo sapiens
  misc_feature: GYAE6OF02HKL8Q.19.71.G05.1.454.CMB.1.raw
  modified_base (574)..(574): a, c, t, g, unknown or other
  misc_feature (574)..(574): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttctcctcgcccgtgcgtcgggccctccacgaggtcgtcctgtcaactaagtacagctgcagcagtcgacggtccaggactgggtagaccgccctcgacacgtaccctcgtccgctccaccgtgacgcctacgtccggtaccggggacacggtacgtcgcgtacgacgtacgtaggtttcggttcgtaccgttcgaccgtacggttcgggtcggacggtcctacccgttccccaggtacggaggtacgttacgtaaggtacggttcgggacggtaaggggaacgtacgttacgttactttacgacgtttacgtaaccgtaacggtacggtaacgttaaaacttaacggtaaactttacgtaccgtacccaaacgttcgtttaccggttggtacggtaaacggtacggttaccgaacgttaacgaactaacgtaacgtaaaccggttaanaaccgacgttaagtaaaccggaaacgtaacccgtttgtacccttcgacgtacgtacctcgttacgaccttgggtacgtaccgacccgtaacgggacggtaaccggttcggttacgtaacgttaacgttcgggtaacgggacgtaacccggacccgtaacccgttagtaccgtaccg

SEQ ID NO: 279278 - DNA, 788 bp, Homo sapiens
  misc_feature: GYAE6OF02I3C0R.19.71.G05.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (671)..(671): a, c, t, g, unknown or other
  misc_feature (671)..(671): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtgcccgacgggacatcgtgatcgacccgagtcctccatacctcctggctgtgtctgnggcgnggccggccactagtcaacgtgactaacgtcccaagccctaactaactttcgttttaaacacgtacgttacccgaaacctaaagttaacgtaaaaacgttaccgttacgtacgtttaccggtaaaccgagaccgtaagaccgtaaccgaacggtaacaccggttcccgtacccgttaaggtcccgtagtacccgttacgtttaaccgtttacggtcgggtaccttaaccgttacccggaaaccccggggttacggttccccggggttaccccgtaccgggtaaccgtacgttacggacgttcgggaccggtacggggtccgggttacgggtaacgggtacgtaacgttactttaccgaaccgtccttaccggaaccctagtaccacggtaccgaccgtcccgtcgaccgtacggcctaaggtacgtgtacggtgtacttagtttactagttacgtaactaacgtaagttttnttaacgttacgttacgttcgtacgggttaccgtacgggaaccggtaaacgtcgggtaaacggtacgtacttaagtaccggtaacggtaccgttaggtccgaggtaccgtacgtaacg

SEQ ID NO: 279279 - DNA, 827 bp, Homo sapiens
  misc_feature: GYAE6OF02HBA3Y.19.71.G05.1.454.CMB.1.raw
  modified_base (191)..(191): a, c, t, g, unknown or other
  misc_feature (191)..(191): n is a, c, g, or t
  modified_base (255)..(255): a, c, t, g, unknown or other
  misc_feature (255)..(255): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacattcgtgatgacccagtctccagactccctggctgtgtcncgtgggcgtagcgggccaccagtcaacgtggactaacgtccaggcccaactaattccttttaanaccgagtttacccaaacaatacgtaaaacttaccttaagtcttcggtacctaacggacaaggacgtaacccgaaggaaccgaacgaccccgtcccgtaaggtcctcgaccgtactacttttaactggggtacctacttacccgtaacccggggtaagttccccggggggtaccctacgggtaacccgtacgtttacgtaaccgggttcgggccgacggggtaccgggggttcgttacgggggaaccttaacgggtacttttccgaacccgttcctaaccgtacccgttaacgtacctaggtaccgacgtacccgtacggccgttacggaccgttaacggtaacggaacgttagggttcgggacttaagggttttaactttagtttacggtaaccgtaaaaccgttaattaacgttttaaacgtttaacgttaaccgtttaccgggtaaccggttccggttaaccggtacccgggtaaacggaacccggttaaacgggttcgttaacgttaacgttaaccgaaccgggtaccgttaaacggtccggtttaggtacccgttacccgtaacccgg

SEQ ID NO: 279280 - DNA, 967 bp, Homo sapiens
  misc_feature: GYAE6OF02HS24N.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtgctgtcgtctcgtgggcgaggccggccacactacaactcgacgtaacgtccagacccaactaacttacttttaagacctacgttaccaaacgtaatacgtaaaaaccttacttagtaccttacgggtaaccacggtaccgaaggaccgtaacccggaacggaacccgtaccggtaccccgtttacccggtaagggtcccgttacgtcccgtaaccgttaacgttttaccgggtacggggtaaccctaaccggtttaaccccggtaaccccgggggtaaaccggttcccccgggggtttaaccctaccgggtaaacccggttaatttaccggacgggttaccgggtccgtaacgggttcccgggggttaacgttacggggaacgttaacgggttacctttacccgtaaccgtttacccgtaccccgtaaccgtaacgttaccccgtaacggtcccctaaacgggttcccgtaacgggacccgggttaacgggttacccgttaaggggttaaacgttcggttttaccgggaaccggtttaacggtttttaagttttaacgtttaacgtttaacccggtaaaccttaaaactttacgtttaaacgtttttacgtttaaaccggttaccggtttaaacgggtttaccgggtaacccggttttaccgggtaaacccggtaaaccggggttaccggtaaggggtttaacgtaaacggtttaaccggtaaccgggtaacggtaaccgggttaacggttacggtttacccgggtaacgtacccgtaaccg

SEQ ID NO: 279281 - DNA, 906 bp, Homo sapiens
  misc_feature: GYAE6OF02GGXUZ.19.71.G05.1.454.CMB.1.raw
  modified_base (248)..(248): a, c, t, g, unknown or other
  misc_feature (248)..(248): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtgcccgacggggacatcgtgatcgacccagtctccagacctccctggctgtgtctcgtggcgaggccggccaccatcaactgacaagtccacgccaactaattcttttanactacgttaccaaaactaataacgaaaaccttacgttaagtccgtttacggaacccagactaaacggacgtaaccccgaagggaacctacgggtccccttaaccggtaacgggtcctttcggaccttacgttacgtttttaacggcgggtacctaaccgttaccccggtaaaaccccggggtaccgttaccccgggggtaccccttagggaaccccgttacgtttaccgaacggggtcggtacccggtacggggtaccggggttacggttacggggaaaccctaaggttacctttttaccacccttacccgtaaccgtaaccctacgttacccgaacgtaccgaaccgtccctaggaccgtaacggttcgttaaggaaacggtacgttacgggttacggtaaccgtttaagtttttaacgtttaacgttaaccgttaaaccttaaaaccttaaatttttaacgttttaaacgttttaacttttaaacccgggttttaccggtttaacgggtaaccgggttttaccccggaaccgggtttaaaaccggggtaaacccggtttaacggggttaaggttaaaacttaacccgggttaacgtaaaccgggttaaacggtaaaccctttagggggaccgtttacccggttacggaaacccccg

SEQ ID NO: 279282 - DNA, 777 bp, Homo sapiens
  misc_feature: GYAE6OF02GIMJV.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgaggccggccaccgatacgaactgacaacgtccagaccacaattcttttatactacgttaccaacaatacgaaaacttacgttacgtacgttacggtacccagtacgaacggaggaacccgtaaggaaccaccggacccttacccggtaaggtcctcgtcctacgtacgtttacgtcgggactacgtccggttaacccgggtaacgtcccggggttacctacggtaaccgtagttacgtacggtcggacgtagggccggggttactacggggacgttacggtacgtttactaccgtcgttaccacccgtataccgacgtaccgacggaccgttcggaccgaggtacgtaacggtaaggtagttacggtacgtacgttagttttacgttaacgttttacggaaccttaaaagttaaaccgttttaatttaacgggttttaaacttaccggttacgggttacggtacccgggtttacgaacccgggtaaaccgggtaacgtaaacggggtacgttaaacgttaaccgttacggtaacggtaaccggttaaaccgttcgggtacggttaccgtaggtaacccc

SEQ ID NO: 279283 - DNA, 1085 bp, Homo sapiens
  misc_feature: GYAE6OF02IKEB8.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggactctctggtcgcccgacggggactacgtcgtcgaattcgaaccctagtcctccacgtacctcccgtgggtacttcggttcgtcctccggttcggggaccggacgggtaccggggccctaaccgtactaccgtaaaccgttcgaaccgtaacgttcccgaacggaccctaacgttaactttaccgttttaagaccgtaacggttacccaaactaaacgtaacggtaaaaacccttacgtttaacggtaccgtttacggtaaccctacggacctaaacggaccggtaaccgtaacgggtaacccaaccggttccccgttaaccggttacggcccgtttacggaccgtttacttaaacggttttaccggacgggtaccttaaccggttaccccggttaaacccggggtaacggttccccgggggttaaccccgttaacgggtaaccggtttacggttaaccggtaacggggttaaccgggtacgggggttaacccgggtttacggtaaccgggttaaaccgtaaccggttttaacgttaacccgttaaccgttcccggtaaaccgttaacccgtaacggttaccgtaaccggtacccgtacggttaccccgtaaggtacccgggaacgtttaacccgggaaggtaaccggtttacggttacgggttaacgggttaaccgtttttaaaggtttacctttaccgggttaaaccgtaaaccgtttaacgtttaaaccggttttaacttttaacccgtttaacggtttacccgggtaaccggttttaaccggggtttaaccccggtaacgggtaacccggggttaaaccggtttaacccggggttacggttaaaccggttaccggtttaaaccgttacccggtttaaaaaggttaccccggtttaggggtttaacccggtcccggtttaaacggttaccccggttaacccgtttaaccccgg

SEQ ID NO: 279284 - DNA, 810 bp, Homo sapiens
  misc_feature: GYAE6OF02HW9C3.19.71.G05.1.454.CMB.1.raw
  modified_base (249)..(249): a, c, t, g, unknown or other
  misc_feature (249)..(249): n is a, c, g, or t
  modified_base (740)..(740): a, c, t, g, unknown or other
  misc_feature (740)..(740): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtcgtctcgtgggcgaggccgggccaccatcaactgacaagtccagccaacaattctttaanacaacgttaccaacaaagtactaaaaactacttagcttacggaaccagccaagaacgaccgaggaccacgcctaccgtaggcttcgcttactactttacgcgggtctaccgtaccggtaacccggggtacgttacccgggggtccctaggtaaccgtacgttacgtacggttcgggacaccggggtccgggttacgtaacggggtactaacgttcgtttaacccgaccgttacctacccgtaaacctcgttaccgaacggaccgtaccggtacccgttgggaccgtaacggttccgaagggtaaaggtaggtttccggggttagggtaccttttaagggttttttaacctttaagggttaccggtaaacccttaaaagttaaattttaaaccttttacggttaactttaaaccggtttccggggttaaccgggtttaccgggttacccgggggtaacccgtaaacgggggtacccggtaaaacgggggttntaaacgttacgtaaccggtaacggaaacccggttacgtttaacgggtcggtaccgtttacggtaacccgg

SEQ ID NO: 279285 - DNA, 642 bp, Homo sapiens
  misc_feature: GYAE6OF02GXK3S.19.71.G05.1.454.CMB.1.raw
  modified_base (266)..(266): a, c, t, g, unknown or other
  misc_feature (266)..(266): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (524)..(524): a, c, t, g, unknown or other
  misc_feature (524)..(524): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctcgtggtcgcccgacgggacatcgtgatcgacccagtctccagactcccgtggctgtgtcctcgtagggcgaggccggacccaccagttaccaacgttcgacgaaccgtccacgacccaactagttccttttaanacgtacgttaccaaacgtataacgtaaaacttcgttagtcttacggtaaccagcagtacgaccaggacacgtcctacgngctcgacttcgtagtttacgnggactacgtaccggttaacccgggacgttcccgggtcctacggaccttagtcgaggtcggcgacggttcggtacgtaggactagttcctttacgactcgtaccgacctagtcgacgtatacgccacggtacgccgtgtaaggattcgtggaaccgttntagtttactagtacgacctaaagtaatttcttaattccgttagttcgacgtacttacgggaccaagggttaacggagttcaacgtactaggtaacgagttcggtgaccgtgtaacctc

SEQ ID NO: 279286 - DNA, 929 bp, Homo sapiens
  misc_feature: GYAE6OF02GW4QB.19.71.G05.1.454.CMB.1.raw
tcagtactctcgtgcacgaccggtgctcgatttagtgtcgtcgcaagagagaggggggaggtacaacaggcaggcagggcagcaagatgtgttgcagacccaggtcttcatttctctgttgctctggatctctggtgcccaggggacatcgtgatgaccagtctccagactccctggctgtgtctcgtcgggcgacggcgggaccaccgtactacctaactcgactaacgtccacgaccaacgtaacttacttttaacacgtacgttaaccaaactaagttaacggtaaaaacctttaccgtttaaggtaccgtttacggttaaaccagtacgtaacggtacgaaccggtacgggaaccacggtaccccgtttacccggtagggaccgttacgaccttactaacggtttttaaccggtagggggtacctaacggttaaccccggggtaacccccggggttaaaacggtttccccggggggttcccccgttacgggaaacccgttacgtttaccggaacggggttacgtacccggtacggggtaccgggggtttaccgtaccgggggtaaacgttaccgggtttaacctttttacccgtaaccgttacccggttaaccctaaccggtttaaaccgtccgtaaaccgggtacgtaaccccggtaaccgtccgggtaaccgtaacggggtaccggttaagggttaaaacgtacgggtttcgggtaaccgggttaaacggttttaacggtttttaactttaaccgggttactttaaaacccggtaactttaaacgtttaggttttaaacttacgtttaaccggttcgggttaacgttaccgggttaccgtaccgggtaaggtaaccgtaacgggttaggtaaccgttagaaccgtaaggaaccgttaacgtcggttacggtactacgtaaccg

SEQ ID NO: 279287 - DNA, 626 bp, Homo sapiens
  misc_feature: GYAE6OF02FXWXP.19.71.G05.1.454.CMB.1.raw
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (435)..(435): a, c, t, g, unknown or other
  misc_feature (435)..(435): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccgatcaactgacaacgtccagccacaattcttttaanactacgttccaaactaatagaaaaactcttagcttacgtaaccagcagacgaccaggacacgcctcgaggctgctnatttacgnggtcatccgtaccgggtacgtcccgggtcctagaccgtacttcgacggttcggacgacgggtcgggtcgtaggggacctagtacgttttcacttctccgaacctntcagccgtacgtccgtgcgaggcttaggacgttgttcggtacggtacgtttaacgttttagtacgttactaaccgtaaataattttagtttaactttaagttacccgtttaggacggttcgttaccgggacgtaacgggtactaaggtcgattacgtacgaacgtacgtacgttggacgtcgtacggtacc

SEQ ID NO: 279288 - DNA, 746 bp, Homo sapiens
  misc_feature: GYAE6OF02I0N5Y.19.71.G05.1.454.CMB.1.raw
  modified_base (352)..(352): a, c, t, g, unknown or other
  misc_feature (352)..(352): n is a, c, g, or t
  modified_base (472)..(472): a, c, t, g, unknown or other
  misc_feature (472)..(472): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacagtcgtgactcggaccctagtctccagtacctcccgtggctgtgtctcgtgggcgagcgggaccacatcaactcgacaacgtccagccaactattcgtttacactagttaccaataataacgaaacttacttagcttaggtaccagtacaggacgaccgtaaggacacgtcctacgtaggctcgacttactaagttacgnggcgtaactcccggtaaccgggaacgtccggggtccctacggaccgtagttcgaagtcgggacgagggttccggggtacgtgggaaacgtaggtttctttcgtacgtaccacctaaccgntaccggtacgaccgtacgccgttcgggaccgtaggcgttaaggtaacgttacgggtcggtaacgggtactttaaggttttaaccgttgtttacccgtaactaaaacgtttaattaagttttacgtttaaaccgttacggtttaccgggtacggttaacccgggttacggaaccggttaacgggtaaaccggtaacgggttagggtaaaccttacggttaaccggtaacggtacccggttaacggtttagggtaccggtacggtaacgtacccgg

SEQ ID NO: 279289 - DNA, 756 bp, Homo sapiens
  misc_feature: GYAE6OF02GOO3F.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccactaacttctttaatactagttaccaacatacgaaaactacttagtccttaggtaccagacagacgaccacggacacgtccctccgtaggcttcgaccttacgtactttaccgtcgggactaacgttcccgtaacccggggtaacggtccccgggggttacccctacgggaacccggtagttccgtagggtcggccgacgggtccgggtacggtacgggacgtagttaccgtttaccaccttcgtaaccctaccgaactaccgacggaccgtacggtcccgtacggtccgtacggtccgtaaggtaacgttaggttcgggttacgggtacgttttaagttttaacgttttaacggttacgttaaccgtaaaccttaaactttaacgttttaagtttaaacgtttaccggtttacgggtacgggttaccggtttacgggaacccggttaaccggggtaaccgtaaggggttacgaagtttacggtacgtaacggaaccgggttaacgtagggtccggtacgttacgaacccg

SEQ ID NO: 279290 - DNA, 818 bp, Homo sapiens
  misc_feature: GYAE6OF02HRMMX.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctgatctcgtggtcgcccgacggggacactcgtgacgtcgaccccagttctccgtagaccttccccgtggccgtgtcgtccttacgtcgggacggacgccgggaccctaaccgactacctaactcggacctaacggtccacgaccctaactaactttcttttaacacgtacgttaaccaaactaagtaacgtaaaaaccttacttacggtaccgtttaccggtaacctagtaccaacggaaccggtacccgtaaggacccgtaaccggtcccctaccggtaaggtccccggtctaccgttaccgtaaagtttttaccgggacggtacctaccgttaaccggtaaccccggggtacggttccccggggttaccctagggaacccgtaacgtttacggaccggtttacggtaccggaccggtacgggggttaccgtacgggaacgttcgttaacgttttcaccgtttaccgacctaacccgtactaccggtacgtcgtaaccgtcgtacgtaaccggacgttacggagtacgtagttacgtaggtacttaagttttgttagttacgtacgtaaacttagtttactttattacgtacgttacggtacggtaccggttcggtaactaacggggtaactacggtagtaccgttacgaaccgtacgtaacgtggttacggtacgtaccgttagtaaccc

SEQ ID NO: 279291 - DNA, 768 bp, Homo sapiens
  misc_feature: GYAE6OF02IA0SC.19.71.G05.1.454.CMB.1.raw
  modified_base (500)..(500): a, c, t, g, unknown or other
  misc_feature (500)..(500): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccaggggacattcgtgactgaccctagtctccagacctcctggctgtgtctgtcgggcgaggcggtccaccatacaacgtgacaacgtccagaccaacgtaactttccttttaactactaccgtttacccaaaacgtaaagttaacggaaaaactttacgttacggtccgtttaacggtaacccaggtaaccgaaggtaacccgtaaccggacggtaaccaaccggttcccgtaccgttaaggccgttgtacctacgttaacgtttacgtcgggtactaaccggttcccggtaacccgggtacggtttaccccggggtaccttacggacccgtacgttacggttagcggtaccnggggtcccggtagtacgggactagttacttccaacgttctacctactactacgacactcgtacctgacgacgtactacggaaatgggtcgttaggtaccgtttagttttaacttcgttacgtaaacgttaactaatttacgtttaagtttacgttacgggtttccggtaacgggtttcccgtaaacgggtaccccgggtaaagggtaaaccccgtttaggggttacgtacggtttaccgaccgggtaaagttaaccggtagttcgggg

SEQ ID NO: 279292 - DNA, 881 bp, Homo sapiens
  misc_feature: GYAE6OF02H6XGL.19.71.G05.1.454.CMB.1.raw
  modified_base (271)..(271): a, c, t, g, unknown or other
  misc_feature (271)..(271): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctcgtggatctcgtggtcgcccgaggggacatcgtgatcgaccctagtcctccagtcctcccgtggccttgtcgtctcggtgggcgaggccggaccaccgactaccgacgtgacaacgtccacgaccactaattccttttanaccgtagttaccgaaactaataacgtaaaacttacgttaagtccgttaggtaccacgacaacggacgaccgaacggaccacgtcccgtacgtaggcctagtcctacttaacttccggaggtcctagttacccggaaccccggggtaaggttccccggggaccgttagaacccggttaattccggtagggtccgacgtagggtccggtacgtacgggacgtacgtacctttaccgacgtttacccagtaaccctagtacccgtacgtaacgaccggtacccgtaggtacccggtaacggtaacgtttaacgggtaaacgtacggtttacggggtacgttaacccggtttttaagtttttaacgtttaaccggttaaaccgttaaaacccgttaaaattttaaaacggtttaccgttttttaaaacgtttaccggttttaacccgggttttcccggttttaaaccggggggttaacccggtttaaccccggggtaaaccccggggttaaaaacgggggttaacccggtttaaacggggggtttcccgggttaaaattaccccgggtaaaacggtaaaccccggggtttaaggttaacccgggttaccggggg

SEQ ID NO: 279293 - DNA, 663 bp, Homo sapiens
  misc_feature: GYAE6OF02GHG99.19.71.G05.1.454.CMB.1.raw
  modified_base (153)..(153): a, c, t, g, unknown or other
  misc_feature (153)..(153): n is a, c, g, or t
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccanaaggtgtcctgtcacaagtacagctagcagcagtcaggtccaggactggtagaacgccctacgcacgaccctctcgctcacctgtgccatcgtccgggacagagtcgtctagcgacngtgttcgctcggctacgtggtacacgacncgtcccagtcgacgagtctaggagttgacgtacggggaagtacatttagttcacgttgtacccaaacgtacggtaggaaacttaactaaagtttactacgacctaaaccgtactttacgtaggtttacggaacggtaacggttaccgtaaccgtacgaaactaaacgtaaccggtaaacgtaacgaactaaccgtaagtaaacgaaaccgtaaccgtacgttacccgttacgtcgaccgtaacgtccgttaccgtacctcgtacgtaccggtaccgttaccgggacggaacgtacggggttactaagttacggtttacgtcggtaacgggaaccggtaaccggccccggttaagtacggaaccg

SEQ ID NO: 279294 - DNA, 714 bp, Homo sapiens
  misc_feature: GYAE6OF02HX4BI.19.71.G05.1.454.CMB.1.raw
  modified_base (248)..(248): a, c, t, g, unknown or other
  misc_feature (248)..(248): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtcgtctcgtgggcgaggccgggccaccatcaactgacaagtccagaccactaattcttttanactacgttaccaaacaatacgaaaacttactagtcttacggtaccagcagacgaaccaggacacgcctactacggctacgctacccctattacgtcggactagtaccgtaccggggtaacgtcccggggtacctacgtaccgtacttcgagttcggactacgggtcgggtcgacgggactagtactttaccactcctaccacctagtaccgacgacgtacgtcgtacgacgacgtacgtaacggaacgtagttcggtacggttaacgtttaacgtttttaagtttaacgtttaacggtaaccgtaaaactttagtttaacgttttaaatttaaccgttacgtttacgggttacgggttacccggttaccgggaccggtaaaccgggtaacggtaaccgggtagttaaccttaacggtacgtaaacggtacggttaaccggttgggtacggttaccgagtaaccccg

SEQ ID NO: 279295 - DNA, 674 bp, Homo sapiens
  misc_feature: GYAE6OF02GO17Z.19.71.G05.1.454.CMB.1.raw
  modified_base (187)..(187): a, c, t, g, unknown or other
  misc_feature (187)..(187): n is a, c, g, or t
  modified_base (239)..(239): a, c, t, g, unknown or other
  misc_feature (239)..(239): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtntctctgggcgagccgggccaccatcaactgcaagtccagcaacattctttanacagttaccaacaatagaaaactcttagtcttaggtaccagcagagtaaccaggtaccaacgtcctaccgtaggctgtctctactttacgnggactaacgtccgtacccgggaagttccccgggggtcctaggacctatttacagggtcgacgacggtccgggtcgtaggggactaaggtacttttccgacttaccgtcgtaacctagttaccaacgactacgtccgttaggaccttaacgggccgttaaggagtaagtcggtaggtaccgttaaggtttaacgttaacgtttgaaaccttaacgtaagtttaactttaacgttaacgttacgttacgttacgggttacgttaccggaccggttaacggaaaccggtaggttaacggtacttaacgtacgtaacggtaccgtacgtaggtacgtcgtcggtaacc

SEQ ID NO: 279296 - DNA, 745 bp, Homo sapiens
  misc_feature: GYAE6OF02HTVYM.19.71.G05.1.454.CMB.1.raw
  modified_base (259)..(259): a, c, t, g, unknown or other
  misc_feature (259)..(259): n is a, c, g, or t
  modified_base (374)..(374): a, c, t, g, unknown or other
  misc_feature (374)..(374): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgtacggggacattcgtgatcggacccagtctccagacctcccgtgctgtcgtctcgtggcgaggcggaccaccgtatccaacgtcgacaacgtccacgccaactaattcttttaanacctacgttaccaaactaagtacggtaaaaaccttcttacggtccttaggtaaccaggacaagacgaccaaggtaccaagcccttacgacggacctcgcctactaagtttaccgngggtacctacgtacccgtaacccgggtacgttccccgggggttacctcggtaccgttacgttaccgtacggtcggaccgtacggggtccgggtacggtagggaactaggttaacgttttcccgaccttacgtacctaacccgtgtaaccgacggtcaaccggtcctaggaccgtacggacgtacgaaagtcgttcgtacgtacgtttaagtttagttacgtacgttaacctaataatttaacctttaagttacgttacggttacggttcgtaaaccggttcggaaccggtaaagggtaaccgtaagggttataacgttaagcccggtaaacgaacggttaccgtttagggacgttaccgtaccgtaacccg

SEQ ID NO: 279297 - DNA, 767 bp, Homo sapiens
  misc_feature: GYAE6OF02FW8F7.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtcctccagacctcccgtggctgtgtctcgtaggggcgacgccgggccacgatccaactcgactaacgtccacgcctacaactttcttttaacgactacgttaccaaactaagtacgaaaacttcttagccttagtaccagacaaggacgaaccaaggaccacggcctacgtacggctagcctataacgtttcggagggtcctaactaccggtaacccgggtaacgttcccggggtaccctagggtacccgtattacggtaggtacggaacgtcggtcggggttacctaggggaaccaggttttaccgtttaccgtaccgttacgtaacccgtacccgtaacgtacggtaaccgtcccgtaacggttacccgtgggacccggtaacgggttaccgtaacgggtaaaggtcggttacgggttacggttcgtttaaacggtttttactttaaggtttacggttaaacttaaataaactttagttttaaacgtttaacttaccgtttacgggttaccggttaacggttacccggaaccggtaacgggtaaccggtaggtaacgtagtactacgacgtacggtacgttagtcggtactcgtaacc

SEQ ID NO: 279298 - DNA, 906 bp, Homo sapiens
  misc_feature: GYAE6OF02FQ4NV.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtcctccagacctcccgtggtctgtgtcctcgtgggacgacggccgggccacgtactacctaacgtcgaccgtaacgtaccgacgacccaacgtaactttcttttaacgtacgtaccgttaaccaaactaaagttaaccggtaaaaacttacgtttaacgtaccgtttacggtaaccgacgaccgtaaaggaaccggaaccggtaagggtaacccaaccggttccccgttaaccggtacgggtccgttacgtaccgttaacgtttaacgtttacggtcggggtaccttaacggttaaccccgggtaaccccgggggtaacggttcccccgggggttacctaaccgggtacccgtaacgtttaccggaaccgggtttcgggaccgttacggggtacccgggggttacgttaaccgggggaaaccgtacggttttaacccggttttaccctaaccgtttacccgttaacccgaacccggttacgttaccggaaaccggtccggtaaaccggtcccggttaacggtacccggacgggttacccggttaaggtaaccggttaggttcggttacgttaacgtttaacgttttaacgttaacgttacgttaacgtaaaacttaagttacgtttaatttaacgttccgttacggttacggtaccgttaccgaacggtaaccgggtaacgtaggtaacggtacgttagtacgtaacgtacgtaaggttcgtacggttcgacgtacccg

SEQ ID NO: 279299 - DNA, 798 bp, Homo sapiens
  misc_feature: GYAE6OF02FPRNL.19.71.G05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
tcagtactctcgtgcacgaccggtgctcgatttagtgtcgtcgcaagagagagggggagagtctgctgaattctggctgaccagggcagtcacagagctccagacaatgtctgtctccttctcttcttcctgcccgtgctgggcctcccacgaaggtgtcctgtacacaagtacagctgcagcagtcaggtccaggactggtnaacgccctcgcacgaccctcgtcgctcacgtgtcncctagtccggtccggggaanacggaggtcgactacggccgaacgtaggtttcggttacgtcgttcgggccgtacggttcggggttacacgggtccaaccggttacccccgtagtacggaacgttacgggttaccgttaacggtaggtcgggtacggtaacgggggtaacggtaaccttacgtttactttaccgtaggttaccgtaccctaagtacggggtaacgtaaacttaaacgttaaagttcacgtaccacttactcgttagttaggtacgtaggtaccgtactaggtaacctaacgtacctaaacggtaacgtaccgaacttaacggtaccgaaaaccggttaacccttaccggtttaccccttacccggttacggtaaccgaccgttccgttaaacccgttacccgttacgtttaccggtcccggttaaccccgtacccggggtaaacgggtaaccgttaaccggggttaatttaacccggttacggttttacggtaacgggtttaaccgggaaccggttaaccccggaccccttaaagggtacccgttaaccgg

SEQ ID NO: 279300 - DNA, 756 bp, Homo sapiens
  misc_feature: GYAE6OF02H9H1Y.19.71.G05.1.454.CMB.1.raw
tcagtactctcgtgcacgaccggtgctcgatttagtgtcgtcgcaagagagagggggcagagtctgctgaattctggctgaccagggcagtcaccagagctccagacaatgtctgtctccttctcttcttcctgcccgtgctgggccctccacgtaggtcgtcctgtcacaagtcagctgcagcagtcaggtccaggactggtcgaacgcccctagcacgtaccctctccgctccacgtgtacgcctacgtccggtaccggggacaggacgttccgcgtaacggcgtaacgtaggttggtttcgacgttcgggccttaacgggttcgggtaccacgggtcccgaccggtaccccgaggtaaccggtaggtacgggttacctaggggacggtcgggtccgggtaaggggtaaacgtaccgttaagttaacggttttacgaaaccgttacggtaacccttaaaccgggtaacgtttaacggttaaaacgttaaacgttaaaagttttaccgtaccgaaccgttaccttaacgttaccgttagggttaacggtaacggttacgtaaccggtactacgttaaactaacgtacgtaacgtaacgtacctaacacgtaaccgtaacgtaacctaccgttactaccgtcgtccgaacgttctaccggtaccttcggtcgtaccgtacccgtcggaacggtaccggtacggttacgtacgttagttcggtagtaaccggacggtaccgtaccccgtataaccgg

SEQ ID NO: 279301 - DNA, 703 bp, Homo sapiens
  misc_feature: GYAE6OF02JYAYI.19.71.G05.1.454.CMB.1.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagagagggggggagtacaacaggcaggcaggggcagcaagatggtgttgcagacccaggtcttcatttctctgttgctctggatctctggtcgcccgacggggacagtcgtgatcggaccccagtcctccagtacctcccgtggctgtcgtctcgtggcgacgccgggccacgntacaactnacagtccagcctacattcgttanactacgtaccaactaanacgtaaactacttagacttggacanctagacgacaggacncgcctacgtggacngccttagtactttcggaggtctacgttccgaaccgggttaccgtcccggggttaccctcgggaacctcgtaccgtaggtccggacggacgggtttcgggcgttaacggggataccgttcttttacggaccccgttacaccgacctcgtacggtagcctacggtcctgaccggtacgtagagtaacgtcgtaaggtcgtaagtttacggtttaagttggtttacaaccttaagttaaatttactttaagttaccgtttacgttaccggggttaacgttcccggttagggtaaccggtacggttaacggaaaggtttcggtaacttcgtaaacgtacggtaaaccggttaccggttagggtaccgtacggaccgttaaccgg

SEQ ID NO: 279302 - DNA, 645 bp, Homo sapiens
  misc_feature: GYAE6OF02I32GY.19.71.G05.1.454.CMB.1.raw
  modified_base (204)..(204): a, c, t, g, unknown or other
  misc_feature (204)..(204): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggccctacccacaaggtgtcctgtcacaagtacagctgcagcagtcaggtccaggctggngaagcccgtcgcacgaccctctccgctccgacctgtcgccagtccgtccggggacagagtccgactagcgacgtgtgtcgtcttggctaggtcgggtcgaggcctacgtcccagtcgaaggtcggtctaggnggtcggcgtagggaacgactatttatctagttcgacaagacggtaagaactaactaaattgtacgactaccgattcgtacgttaggacgtacggttacgacgtacgaacgtaactaacgtaacgtaacgaacgtaacgacgtaaccggtaaacggtaaccgtacgtttaccctaccggtacgaccgtacgtacttaccgtccttacgtacgttacgtacccgtaccggacgggtaacggttacggttacggttaattacgttacggttacggtaacggtaaccggaaccgaccccgtagtacgtaaccg

SEQ ID NO: 279303 - DNA, 758 bp, Homo sapiens
  misc_feature: GYAE6OF02HNUY4.19.71.G05.1.454.CMB.1.raw
  modified_base (746)..(746): a, c, t, g, unknown or other
  misc_feature (746)..(746): n is a, c, g, or t
tcagtactctcgtgcacgaccggtgctcgatttagtgtcgtcgcaagagagaggggggagggtacaacaggcaggcgaggggcagcaagatggtgttgcagaccacggtcttcatttctctgttgctctggatctctggtcgcccgacgggacatcgtgatcgaccacgtctccacgtacctcccgtggaaaactgtcgtctcgtgggcgaggccgggcccaccactacaacgtgactaacgtccgacgccaacgtattcttttactactacgttaccaaactaagtaacgtaaaaaccttcgttaagtcgttaccgggtaccaagcaaggtacaaccgaacggacaaccgtcccctccgtaggtactccgtactccttaacgtttaccgtcggacttaccgtaccccggttaacccggggtacgtccccggggggttcccctacggaaccgttcgtacgacgggtcggctacggggtccggggtagtacgggacgtaaaggttacttccgtacctccgtaccacccggttatcgaaccgtacgtaacgtccggtacgacgggtaccgggtattaaacgggtacgtacggttccgggagttacgttattttaacggttatttacggaactaacgttaagtttaactttagttaacgttacggttcggtacgggttaccgtccgggtaaccggaacggtaacggtaaggtaggtaacgttcgaacgttacgaacgtttagacgggtntcgtacgtaccg

SEQ ID NO: 279304 - DNA, 798 bp, Homo sapiens
  misc_feature: GYAE6OF02J0RCY.19.71.G05.1.454.CMB.1.raw
  modified_base (186)..(186): a, c, t, g, unknown or other
  misc_feature (186)..(186): n is a, c, g, or t
  modified_base (656)..(656): a, c, t, g, unknown or other
  misc_feature (656)..(656): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctctttcttcctgcccgtgctgggccctacccacaaggtgtcccttgtcacaagtcagctgcancgagtcacggtccaggactggtcgaacgccctcgacgacgtacccttcgtccgactcctaccgtggtcgccctacgtccgtaccggggacgaagtcggtacgccgttacggaccgtacgtaggttcgttcggtcgttacggtacccgtaccggttggggttaccacgggtaccgtaaccggtcccctaagttccggtaaggtacgggttaccgttaacggcggttaggtccgggtaagggggtaaacggtaacccttagttttaacgtttaccgtaacgttaaccgtaccccgtaaaacgttacgggttaaacgtaaaacgtttaaaccttaaaagttacggtacggtaaccgtacccgttatacgggtttacgttagggaacggtacgttaaccgggttctaacgtaacggtactacgtaaaccgtcgaaaccttaccgaagtaccgaaacgttaccgacgtttacccncccgttagaaccgttacgttaccgtacctacgttccctaaggtaccgaccgttacggaccggtaacggtaacggttacctaaggttacctttagggacggttacggaaaccccggtccggtaaccccaggttcgtaaacccg

SEQ ID NO: 279305 - DNA, 671 bp, Homo sapiens
  misc_feature: GYAE6OF02I0DON.19.71.G05.1.454.CMB.1.raw
  modified_base (268)..(268): a, c, t, g, unknown or other
  misc_feature (268)..(268): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (496)..(496): a, c, t, g, unknown or other
  misc_feature (496)..(496): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccgacggggactatcggtagatcgtaccccaagtcctaccgacgacctccccgtagtacgtggttcgtctccgtggggcgaggccggccaacatcaactgacaacgtcacgccaactacttctttanacacttaccaaactatagaaactacttagtcttagtaccagcgaagacgaaccgaggacgaccgtccgtaccgtacggtctcgcctacttacgtttacgcgggtactacgttaccgtaccggggtaacgtccccggggtcgtacgaccgtatccgtacggtggcgtacgtcgggtcgtaggacgtagtctttacncttcncctaacnctnacgcctaggctacgacgnggtacgtaggtaaagtcggttagtcgggtaactttggtttaacttagttacgtaataacgttaactttatacgttttaactcggttacgtacgtacggtaccgaacgggtaacggtcgtaagggtactaagtccgtaagtagtaccggtaaaggtgtacgttacgcttaacccgg

SEQ ID NO: 279306 - DNA, 732 bp, Homo sapiens
  misc_feature: GYAE6OF02IINL9.19.71.G05.1.454.CMB.1.raw
  modified_base (148)..(148): a, c, t, g, unknown or other
  misc_feature (148)..(148): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttctcctgccgtgctggcctccanaaggtgtcctgtcaacaagtacagctgcagcagtcaggtccgaggactggtgaacgccctcgcacgtaccctctccgcctcaccgtgtcgccacgttccgtaccggggacacgacgtccgactacgacgacaggtcgttgcgtttggcccgtaggtcgggtcacgggtacctaccggtaccccagtacggaacggtacggttaccgtaagggtacggttcggggaccggttagggggaaacggtacgtaagtttactttacgtagttacccggtaccgaaacgtacggttaacgtaaaattaaccgtaaaagttcgtacgtacctaaccgttacgtttacgtttaggttacggaacggtacgttacggaaacttacgaaacttaaccgtaaccgtaaacgtaacgaacctaacgtaacgtaccggtaaaccgtaccgtaacgtttcccgtaccgtagtaccgtacgccgttaaccgtactttcgtagtacccggtaccgttaccggacgggaaccggttacggtacttaacgttagtaaccggttggtaacggaaccggtacccggtaccctaagtaccgtacg

SEQ ID NO: 279307 - DNA, 911 bp, Homo sapiens
  misc_feature: GYAE6OF02IUDIB.19.71.G05.1.454.CMB.1.raw
  modified_base (415)..(415): a, c, t, g, unknown or other
  misc_feature (415)..(415): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgccccacgggacagtcgtgatgacccagtctcagacctcctaggctgtgtctcgtgggcgtacggccgggcccacgactactaacgtcgaccgtaacgtacccgagacccaactaaactttccttttaactacgtacgttaccaaaactaataaggtaaaaaccttacgttacgtaccgttacggtaacccgagtaccaacgaacgtaacccgtaacggaacctacggtccccttaaccggtaggtcctacgtccgtacttaagttttaacccggngggtaccctaacgttaccccggttaaaccccggggtaaccggttccccgggggtacccccttacggtaacccggttaacctttaccggacggtccgggtaacggtaccggggtacccggggtttcggtaacggggtaacccgtacgggtttaaacctttttcccggaaccgtttaccccgttacccgtaaaccgttaaccgttcccggaaccggtaccgtaaccgggacccgtttaccgggacccggtaacgggtacccggttaaaccgggtaaacgttcgggttaaacggtccgggttaaccgtttacgggtttttaacttaacggttttaaccggtaaacctttaaacgtaaacgttttaactttttaacgttaacgtttaaccgttcgggttaaccgttaccgtacccgggtaacggtaaccgggtaacggtacggtaacgtaagtaaccgtaagaccggtaaacctcggttaggaccggtactcgtaacccg

SEQ ID NO: 279308 - DNA, 833 bp, Homo sapiens
  misc_feature: GYAE6OF02JGG5B.19.71.G05.1.454.CMB.1.raw
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
tcagtactctcgtgcacgaccggtgctcgatttagtgtcgtcgcaagagagaggggggaggtacaacaggcaggcaggggcagcaagatggtgtgcagacccaggtcttcatttctctgttgctctggatctctggtcgcccgaggggactagtcgtgatcgaaccngtcctccagacctcctggctgtcgtctcgtcgggacgnggccgggcctacgactacgaactgaccgaagtccacgacctaacgtaattcctttaacacgtacgttaaccaaaccgtaataacggtaaaacttacgttaacggtccgttacggtaaccgtaacggtaccgtaaaggtaaccgaaccggaacggtaccgtaaccgtccccgttaaccggtaacggtccgtacgtcctttacctaacgtttaccgggtacggacttaaccggttacccggttaacccggggtaacgggtttaaccccgggtccctacgggttaaaccctagttccgggtaacgtcgggtaacgtacgggtaccggtcggtacggggttaactaacggttacgttcgttaaccgtaccgtactaacccgtacgtccggaacgtcgtaaaccgtcccgtaggtacggtaccgtacggttaacgtagtacggttcggtacggttacgtttacggttaaacgttcggtaactaccggattaacggttaacgtaaatttaacgggtacctacgggtaccttacgtacggtttacggtcccgggtaacgggtaacggtaacggtaacggtacggttaacggtaacgtaacggtaacggtaaccggtagggttacgtacgtaccgg

SEQ ID NO: 279309 - DNA, 634 bp, Homo sapiens
  misc_feature: GYAE6OF02FQJM1.19.71.G05.1.454.CMB.1.raw
  modified_base (222)..(222): a, c, t, g, unknown or other
  misc_feature (222)..(222): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtcagctgcagcagtcaggtccaggactggtgaagccctgacagaccctntcgctcaccgtgtcgcctatccgtaccggggacaggacgtcgactagcgacaggtgttagcttggctacgtggtacacggtcagtcccagtcgagacgtctagacgtggcgtaggaacgactattacttcgagttcgtaccgaacgtacggtaggtaactaacgtaaattacgtacgacctaacgtacttcgttaggttacggtaacgtacggtaccgtacgtacgaactaacgttaacgtaaacgtacgtaaccgactaacgtacgtaaacgtaaccgtacgtttaccgtacccgtagccaagtccgtacgtaccttgtacgtcgaccgtaccggtaacggtaaccggtacggtacgttaacgttagttaccgttggtaaccggtaacggtaccgtacccgtagtaaccgg

SEQ ID NO: 279310 - DNA, 732 bp, Homo sapiens
  misc_feature: GYAE6OF02HQVNJ.19.71.G05.1.454.CMB.1.raw
  modified_base (118)..(118): a, c, t, g, unknown or other
  misc_feature (118)..(118): n is a, c, g, or t
  modified_base (160)..(160): a, c, t, g, unknown or other
  misc_feature (160)..(160): n is a, c, g, or t
  modified_base (232)..(232): a, c, t, g, unknown or other
  misc_feature (232)..(232): n is a, c, g, or t
tcagtactctcgtgcacgaccggtgctcgatttagtgtcgtcgcaagagagaggggggaggtacaacaggcaggcaggggcagcaaagatggtgttgcagacccaggtcttcatttcnctgttgctctggatctctggtcgcccgacggggacagttcgngatcgaccctagtcctccagtacctcccgtggcttgtcgtctcgtgggcgagccgggaccactatcaacgtnacgaacgtccagaccaactattcttttaacacgtaacgttaccaaactaactacgtaaaaccttcgttagaccttaggtaaccagacgaagtacgaaccgagaacaccggtcctacggtacggctcgacctacgttactttaccggcggtactaccggttacccgtaaacccggggtacggtccccggggttacctcggggtaacctacgtttcgaggtacggacgacggtccgggtacgacgggtacagttcgtaccgtactactacccgtactactacgacgtaccacgtctcggtacgacgtacgtagtaagtacgttcgtacggtacgtttacgtttagttacgttaacgtacgtaattaattacgtttaacgttacgtttacgtacgggttaccgttaccggtacggtaaccggtaaacgggtaccggttaacgggaagttaccgtacgtaccggaacgtacggttaacgtcgggtaacgtacgtaccgtaaccg

SEQ ID NO: 279311 - DNA, 668 bp, Homo sapiens
  misc_feature: GYAE6OF02IHZO9.19.71.G05.1.454.CMB.1.raw
  modified_base (250)..(250): a, c, t, g, unknown or other
  misc_feature (250)..(250): n is a, c, g, or t
  modified_base (343)..(343): a, c, t, g, unknown or other
  misc_feature (343)..(343): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagaccttccctggctgtgtctcgtgggcgaggccgggccaccgactacgactgactaagccagccactattactttanactagttaccaactaagtacgaaaacttacttagtcttacggaccagacaagacgaaccaggacacgcctacgtaggctgactcgtatttcgnggctagtccgtaccgggtacgtcccgggtccagtaccgtacttcgacggtgcgacgggtcgggtactacggggactagtactttacgaccgtttacgtaccaaccgtacgttaccacgtacgacggtacccgtgaccggaggtacgtaaagactacggttggtcgtatttaacgttttacgtcgtttaactacgaaacttaaagtttacttttacgttaacgttacgttccgttagtaacccgttcgggaaactacggggtaaccgttaaggtacggtattacggtacgttaggaaacccgttagtggttccgaccgtcgtaccg

SEQ ID NO: 279312 - DNA, 816 bp, Homo sapiens
  misc_feature: GYAE6OF02HAS6W.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtgcccgacggggacagtcgtgatgacccagtctccagcctcccgtggctgtcgtctctgggcgagcggccacatcaactgacgaagccacgccactaactttcttttaacacgacgttaccaaataaactacggtaaaaccttacgttacgtacgttacggtaaccagtacaagtaacgaccgaaggaactacggtccgttaccgtagggctcgtaccgtaccttaacgtttaccgtacggggtctaacgtaccccggtaacccggggtaacgttccccgggggtacctacggtaccgtaacttccggtaaggtccgacgacgggtccggggtacgtcggggtaacacggttaccttttaccgaccctttaccgtacccgtacctaacgttacgaaccgtacgaccgtcccgtacggcgaaccgggtctaaacgggaacgtaggttaccggttgtaacccttttaaaggtttacttacgggttaactaaccgtaaaacttacgtttaacttttaaccgtttaacgttacccgtttacgggttaccgggttaaccggttacccgggtaaaccggttaaccggggtaaaccggttaaccggggtaacggttaactttaaccggtacccggttaaaggtaacccggttccggttacgggttacgtaccggtaggtaacccc

SEQ ID NO: 279313 - DNA, 577 bp, Homo sapiens
  misc_feature: GYAE6OF02FT1PG.19.71.G05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttanacacgttaccaacaatagaaaactacttagcttggtaccagcagagaccaggacagcctcctaggctgctcatttacgngggacataccgtacccgggaatcccggggtcctgaccgattcagtggcaggccgggtgtgggactagtactttcactctacgaccatcgancacgcctgcaggctgaagntggtgctagtttattntagtacaacgtaatacgtttaattattacgttcgttaggtaccgttacggaccgtaagggaacccgtaagggtcgtaagttacgtaacgtaacggtaacggtaacttggtacggtaccgtacggtaaccccg

SEQ ID NO: 279314 - DNA, 714 bp, Homo sapiens
  misc_feature: GYAE6OF02FXJFO.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtcgtcctgtcacaagtacagctgcagcagtcaggtccaggactggtgaacgccctgcacgacccctctcgcctcaccgtgtcgcctatccgtaccggggacaggacgtcgcgtacggccgacgtaggttgttcggcgtttgggcctacggttgggtaccagggtccacgtccccagtcggacggtaggtctaggacggtgggacgtaggggaacgtactagttactttacgagttaccgtaccgaaacgtacggttaaggaaacttaacgtaaagtttctacggtaacctacctagttccgttaggttaggaacggttacgtaccggtaagttacggaacttaacgtaacgtaaacggtaacaaccgtaagtaaaccgtaccggtaaaaccgtaaccgttacgttcccgtaccctaggtacctaacgtcctacgtacccgttacggttctaccggtacccgtacccgggtaacggtaccggttacgggttagtttaaccttaacggttacggtacgggttaacgggaaacccggtccggtacccctagttaaccg

SEQ ID NO: 279315 - DNA, 643 bp, Homo sapiens
  misc_feature: GYAE6OF02I6TON.19.71.G05.1.454.CMB.1.raw
  modified_base (267)..(267): a, c, t, g, unknown or other
  misc_feature (267)..(267): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacagtcgtgatcggaccagtcctccagtacctcccgtggctgtcgtctcgtggcgagcggaccacagtacgaacgtcgacaagtccacgccactaacttcttagactacgtaccaanagtacgaaaactctagacttcgacagcgaagacacgagaactcgaccgtcgtacgtctacgtcctactacgttacgtcggaacttcgtaccggaaccggttaccgtccggtccgtcgacttcgtacgacgtggcgtaacggcggttacngggtactaanactcgactcacanacncgtcactacgcgtcgacgtcgaccgtagagtacgttagtaccgttagttaacgttagtttacgttaccgtaactaaaccgttaattaacgttttaacttaacgttacgtttcgggtacgtccggttaccgacgtaacggggtactaacggtcgtaacgtacgtacggacgtaaccgttacggactacggtactcgtaaccg

SEQ ID NO: 279316 - DNA, 742 bp, Homo sapiens
  misc_feature: GYAE6OF02JY8S2.19.71.G05.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (333)..(333): a, c, t, g, unknown or other
  misc_feature (333)..(333): n is a, c, g, or t
  modified_base (737)..(737): a, c, t, g, unknown or other
  misc_feature (737)..(737): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacagtcgtgatcggacccagtctccagacctcccgtggcttgtgtctcgnggggcgaggtccggccaccntcaacgtgacaacgtccaagccctaanaagtttcttttacacgtcgttacccaataaatacgaaaaacttactacgtaccgtacgtaaccgagccaaggacgaccaacggaccngtccccgtactggacctgtaccttctaacgtttccgaggacctagttaccccggacccgggtaagttccccgggggtacccttacgaaccggttacttcaacggggtcggaccggcgggttacccggggtttgccgggggtaaactaccggtttaaccggtttttacaccccgttacccttacgtacccgtacgttaccgacggtacacgtacccgtgaccgtacggtagttacgaagttacgtacggttcgtacctagtttttaacgttcgttaagttacctaaagttaattacttttaaggttacttaacggtcgtagggttaaccttccggggtaacctaacgggtaacgtacggttagtaacgttacgtacgtaactcgtaaccgtaggttcgaccggtnacccg

SEQ ID NO: 279317 - DNA, 686 bp, Homo sapiens
  misc_feature: GYAE6OF02INAK3.19.71.G05.1.454.CMB.1.raw
  modified_base (231)..(231): a, c, t, g, unknown or other
  misc_feature (231)..(231): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagtactctcgtgcacgaccggtgctcgatttagtgtcgtcgcaagagagagggggggaggtacaacaggcaggcaggggcagcaagatggtgttgcagaccaggtcttcatttctctgttgctctggatctctggtgcccgacggggacagtcgtgatcgacccagtctccagactccctggctgtgtctcgtgggcgagcgggccacatcactgacaagtccagccanaattctttacactacgttaccaactaataacgtaaacttacgtacgtacgttacggtaacagacgagacacgaggacacgcctacgtagctcgctactattacgngctacgtacggtaccggtacgtccggtcctacgactntcgagtgcgaggtcgtgtaggactacgtcttacgactacgtaccactactacgacgtacgacgtcgtaggacgtaggtacgtacggaagtagtacggttacgtacgtttaacgtttattaacgttacgttaacgtaaacttaaattaatttaaccgttttaacgttaacggtttaaccgggttacgggtttaaccggttaccgggaacccgggttaaacgggtaaaccggtaaggggtttacgtaaacgttaaccggtaaaccggtaacgggtaaccggtaacggttacggttacgggtacgtaacccggtac

SEQ ID NO: 279318 - DNA, 759 bp, Homo sapiens
  misc_feature: GYAE6OF02HRSDY.19.71.G05.1.454.CMB.1.raw
  modified_base (153)..(153): a, c, t, g, unknown or other
  misc_feature (153)..(153): n is a, c, g, or t
  modified_base (174)..(174): a, c, t, g, unknown or other
  misc_feature (174)..(174): n is a, c, g, or t
  modified_base (468)..(468): a, c, t, g, unknown or other
  misc_feature (468)..(468): n is a, c, g, or t
tcagtactctcgtgcacgaccggtgctcgatttagtgtcgtcgcaagagagagggggagagtctgctgaattctggctgaccagggcagtcacagagctccagacaatgtctgtctccttcctcttcttcctgcccgtgcgtgggccctccanaggtgtcctgtcacaagtacngctgcagcagtcaggtccaggactggtacacgccctgacacgacccctcgtaccgcttaccaccgttgtccgccattccggtaccgggggactaaggcgtccgacgtacggaccgagtaggttgttggtacctttcggggacctacggtcgggttacacggggcctaccgtacccacgtcggtaagacgggtactaaggcggtggccggtaaggggaaccgatactttagtttaccgactttccggaaacccgaaaggttacggtacggtaaaacttaacttaaacggtttacncggtaaccaaccgttacgttccgttaagggttaccgaaagggttacctacggtaacgtaacgtaaccgtaacttaaacgtaacgttaacgaccgttaacgaaacgttaccgaaacaccggtttaccgttaccgttacccgaagtacgtaccgttaccgttaccggaaccttcggttacgtacccggtaaccgtcccgggttaacgggtaaccggttaacgggtaactttaacgtttaacgtccggtaagggtcccggaaacggtaccccgtacccggaagtaccgtaaccg

SEQ ID NO: 279319 - DNA, 628 bp, Homo sapiens
  misc_feature: GYAE6OF02JTN0P.19.71.G05.1.454.CMB.1.raw
  modified_base (126)..(126): a, c, t, g, unknown or other
  misc_feature (126)..(126): n is a, c, g, or t
  modified_base (248)..(248): a, c, t, g, unknown or other
  misc_feature (248)..(248): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctntggatctctggtgtccacggggacagtcgtgatgacccgagtctccagacctccctggctgtgtctcgtggcgacggcgggaccacatccaactcgcaacgtccagaccactacttctttanactacgttaccaataactataaaactacttagtcgttacggtacaagtacagaacgacgagacacncctaccgtaggctcgaccttacagtttacgngggacctaacggttccgaacccgggtacgttcccggggaccctacggacctactcgtaggtcgcgacggtcgggtactgggaccagttaccttcgactctaccacctatcgacgacgtcgtacgtcgacgtcggtagtaacgagtagtcggtacgtagttgttaacgttagttaccggtactaagttaagttaactttattactcgttacggtacgtacgtcggacgtacggtaacggtacgtagtactagactacggactaccggtacgtggtcctagtacg

SEQ ID NO: 279320 - DNA, 621 bp, Homo sapiens
  misc_feature: GYAE6OF02FHODS.19.71.G05.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattcttttanactagttccaacaatgaaaacttacttanctttggtaccagcagacgaccaggacagcctctaggctcgctctatttacgtgggactatccgtacccgggaagttcccggggtacccctggacccgattcgaggtcggcaggtcgggtcgtggggaccagtatttcactctcacctatcagcacgtcctgacgaggtctagaagtgtcggtaggtacttaaggtttattacgtttaggttaccaaaacgttaaatttaatttaaactttaacttaccggttttcgtagggtaaccgttttacgggacccgtaaagggtacccggtaaggttacggacttaagtcgaaggaccgtaaacgtggtcgggtacttcggaacccg

SEQ ID NO: 279321 - DNA, 678 bp, Homo sapiens
  misc_feature: GYAE6OF02F5ZPV.19.71.G05.1.454.CMB.1.raw
  modified_base (247)..(247): a, c, t, g, unknown or other
  misc_feature (247)..(247): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgagtgacccagtctccagacctccctggctgtgtctcgtgggcgagcgggaccaccgatcaactcgcaacgtcagccataacttcttttaanacagttaccaaactaatacgaaactacttagcttggtaccagacagacgacaggacagcctacagctcgctactattacgnggctacgtaccgtaccgggtaacgtcccggggtacctaggaaccgtattcgaggttcgacgtacgggtcgggttaccgaggaccgtagtactttacgactcctacacctagtccagccgtacgccgttacgcgtacggtctaggaacgtagtacggttaggtactttaaggttttaacttcggttacgtaaccgtaaacgtaacttttaagtttaacgtttaaccgttaaccggtttacgggtaccgggttaacgtttcccggaacgtaaacggggtaaccctaagggtaccggtaacttacggtaccgtaagtaaccgttacggtacggtacggtccgtacgtaacccg

SEQ ID NO: 279322 - DNA, 905 bp, Homo sapiens
  misc_feature: GYAE6OF02GH7DH.19.71.G05.1.454.CMB.1.raw
  modified_base (245)..(245): a, c, t, g, unknown or other
  misc_feature (245)..(245): n is a, c, g, or t
  modified_base (329)..(329): a, c, t, g, unknown or other
  misc_feature (329)..(329): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacagtcgtgatgacccagtctccagacctcctggctgtgtctcgtgggcgagccgggcctacgactacgaactgactaagccagtaccaactattntttaactacgagtaccaaacaataacggaaaactataagctttaggaccagacagaacgaccaggaacgacgtcctactacggntacgcctatagttaccgtgggactacgtaccgacccggtaagttaccccggggtccttacggacccgtagttactacggtacggtaactcgggacccggggtttacgtacggggaacttacgggttaacttttacccgaaccgttccttaaccggaaaccccgtaacttccggtaaccggaaaccgggttccacccgggtaaccgggttacggttaacccggggaccgtttaaacgggaaaacgttacgggttgggttaacccggtaaggtttttaaaacggggttttaacccttttaaagttacccggttaaacctaaaacggttaaaatttttaaaccctttttaaagttttaaaccgggttttaaaacccgttttaggggttaaccggggttttaaacccgggttaaccgggttaaaacccccggggtaaacgggttaaaaccccggggtaaagggggtttttaaagggtaaaacgttttaaaccggtaaccggtaaaaccgggggttttaaaaccgaaaccccggggtttaaaggggttttaccgggaacccggtttaaccgggtaaacccc

SEQ ID NO: 279323 - DNA, 564 bp, Homo sapiens
  misc_feature: GYAE6OF02FGL1M.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaatcttttatacagttccaacaatagaaaactacttagcttggtaccagcagagaccaggacagcctctaggctgctcattactgggcatctacccggaatccggggtcctagaccgattcagtggcagcgggtctggacagactttcactctcaccatcacgcagtcctcgcacggtctaggaatagtgtgtacttagtttattattagtactaaataattaatttaattacttacgttcgtacgtacggtttcggaccgtaacgggtaacctaagggtaggtaacttaacgtacgacggtaacgtaaacgtggtacggtaccttaggtaaccccg

SEQ ID NO: 279324 - DNA, 538 bp, Homo sapiens
  misc_feature: GYAE6OF02GLL57.19.71.G05.1.454.CMB.1.raw
  modified_base (454)..(454): a, c, t, g, unknown or other
  misc_feature (454)..(454): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatccgagaggtctagagtggctggggaggacagtatttcatcgtcaacgacgtggaaataacaaattatgacaccgatctagttagagtagtcgactgaacaatcaagtacgacacaatacgaaagaacctagttcctacctgacagctacgaccttntacgtgacctcccggaggtaccgtaacgggttcgtaagttacttaccgtagtacggaaacgaccggtcccctagtacgtaaccg

SEQ ID NO: 279325 - DNA, 695 bp, Homo sapiens
  misc_feature: GYAE6OF02HC514.19.71.G05.1.454.CMB.1.raw
  modified_base (256)..(256): a, c, t, g, unknown or other
  misc_feature (256)..(256): n is a, c, g, or t
  modified_base (538)..(538): a, c, t, g, unknown or other
  misc_feature (538)..(538): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacagtcgtgatcgacccagtctccagacctcctggctgtctctcgtcgggcgaggccgggaccacgactacaactgacacgtccacgaccaactaacttctttaanactacgttaccaactaaatacgtaaaacttacgttacgcgttacggtaccagacaacgacgaaccgaggactacgtcccgtacgacgtccgtgtacctacgttacgtttacggcggtactaccgttacccggtaacccgggtaggttccccggggtcctacggaccgtactcggtaggtcggacgtcgggtacggttcgacgggactattacgttccgcttaccgacctaactcacgacgtacacgtccacggtcccgaggacgtaggacgttagtcgggtnttacgttaattttactaggttactaaacgtaacgttatttactttaacttacgttacgttcgggttacgtaccggttaccggaacggttacggtaaacgtaggttggtaaacttccgtaaggacggtaaccgtggttacggtcgttacgccgttaac

SEQ ID NO: 279326 - DNA, 734 bp, Homo sapiens
  misc_feature: GYAE6OF02HUN7I.19.71.G05.1.454.CMB.1.raw
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggcggccacatcaactgacaagtccagccaactaattcttttaacacctacgttaccaaacgtaaagttacgtaaaaaccttaccttaggtcctttacggtaacccagtacaaggtaacgaacccgaagggaaccaacggtcccttaccggtacggtccttgtaccttactaacgtttaccgtaggggctaactcccggtaacccggggaacgttcccggggtcctacggaccgtaattccggaggtcggacgtacgggcgggttacgtaggggaactacgttactttccacgtccttaccacctataccgacggtcgtacgtcctaggccgtaacggcgtaacggtaatacggttggtacgggtacttttaacggttttaattacggttaccgaactaaaacttagtttaacgtttaactttacggttaacgttccggttagggtaccggtttacccggaacggtaaacgggacgttaagggtagacgttaacgacgtaacggaacgtacggttgtaccggtacttgaaccc

SEQ ID NO: 279327 - DNA, 824 bp, Homo sapiens
  misc_feature: GYAE6OF02GKW2T.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttatctgttgctctggatctctggtgcccacggggacatcgtgatcgacccagtctccacgactccctggctgtgtctcgtgggcgagcggccacatcaatgcaagtccagccacaattcttttanactacgttaccaaacaatacgtaaaacttacttaagtctttacggtaaccagacaaggacgaccgaaggaccacgtccctaccgtaggcttgactacgtacgtttacgtggggactacgttaccggtaacccgggtaacggtccccgggggtaccctacggacccgtagttccgaggtcggacgtaacgggtcggggtttcgtacggggaccgtaaggttacctttaccgtacccgttaccgtacccaaacccgtacgtaccgaaccggtaccgtaaccggtacccgttacggacccggtacggggttaccgttacggtaaaacgggttgttacgggttacgggtaaccgttttaaagtttttaacgttttacgtttacggttaaaccttaaaacgttaaacttttaacgttttaacgtttaaacggtttacccgttttacgggtaaccggggtttaaccgggtttacccgggaacccggttaaccgggggtaaacccggttaaaggggttacggtaagttaacgtaaccggtaacggtaaccgttaaacgggtttcggtaacgggttccgtacggtaaccccg

SEQ ID NO: 279328 - DNA, 760 bp, Homo sapiens
  misc_feature: GYAE6OF02G545P.19.71.G05.1.454.CMB.1.raw
  modified_base (162)..(162): a, c, t, g, unknown or other
  misc_feature (162)..(162): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (709)..(709): a, c, t, g, unknown or other
  misc_feature (709)..(709): n is a, c, g, or t
tcagtactctcgtgcacgaccggtgctcgatttagtgtcgtcgcaagagagagggggagagtctgctgaattctggctgaccagggcagtcaccagacgctccagacaatgtctgtctccttctcttcttctgccgtgcgtcggcctcccataggtctcctntacacagtacngctgcngacacgtcgacgtcacggtcgtaggagaccgcccgtcgactacgaccccttcgtccgcctaccgtaccttggtaccgacccttacggtcccggtaccgggggaacctacgggtacggttaccgtacggtaccggaccggacgttacgttcggttcggtccggtttaggaacccgtcgggttcgggtaaccggtaccggtacccgtaacccggtccccgttaacggtacggtaaccgggttaccgttaccggtagggtacggtacgggtacggtaaacggggtaacgtactaacgttttacgtaccgtacgttttacccggaaaccgttaacggtacggtaacgttaaataaccgtaaagtttcggaacctacctacgttagtttacccggtggttaacggacggttaacgttccgagtaactacgtacgtaccgttaacgataaccacgtaataccggaatccgtacgttactccgcgacgtctacgttactctacgtcgtacgtaccggtacgtacggacggttacgtnttacccgttagttacgtaacggacgtacggtacccgtactacgtagtaccc

SEQ ID NO: 279329 - DNA, 718 bp, Homo sapiens
  misc_feature: GYAE6OF02JAE09.19.71.G05.1.454.CMB.1.raw
  modified_base (153)..(153): a, c, t, g, unknown or other
  misc_feature (153)..(153): n is a, c, g, or t
  modified_base (247)..(247): a, c, t, g, unknown or other
  misc_feature (247)..(247): n is a, c, g, or t
  modified_base (690)..(690): a, c, t, g, unknown or other
  misc_feature (690)..(690): n is a, c, g, or t
tcagtactctcgtgcacgaccggtgctcgatttagtgtcgtcgcaagagagaggggggaggtacaacaggcaggcaggggcagcaagatggtgttgcagacccaggtccttcatttctctgttgctctggatctctggtcgcccgacgggacntcgtgatcgacccagtctccagtacctccgtggctgtcgtctcgtgggcgaggccggccacgtatcaactgacacgtcagccactattctttanactacgtaccaacagtaacgtaaaccttactagtacttacggtacaagacgaggacgacccgtaaggactaccgtccgttaacgtagtctcggtactacgtacgtttacgacggctaacggtacccggtaacccgggtaccggttcccgggtaccctagtaaccgtcgtttaccggacgggtccgacggtttacggtaccggggttacggttacgggacctttaacgggttacctttccaacgtttcccaccgtaaccgtaacgtcaccggtacaacgggttcctcggaccgtaggtccgaagtaacgttgtcgtagtgttaacgtttagtacctagtaacctaagtacgtttaacttagtttacgttaccgtcggttacgttccggaccgtacggtaacgcgggtaacggttataagtaccgttacgggaaaccttaacggngttttccggaacggtcctaagttacccg

SEQ ID NO: 279330 - DNA, 737 bp, Homo sapiens
  misc_feature: GYAE6OF02FH4QF.19.71.G05.1.454.CMB.1.raw
  modified_base (251)..(251): a, c, t, g, unknown or other
  misc_feature (251)..(251): n is a, c, g, or t
  modified_base (349)..(349): a, c, t, g, unknown or other
  misc_feature (349)..(349): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatcaacgtgcaagtccagccactaatcttttaanaccagttccaaacactacgaaaactacttagctttaggtaccagcagacgaaccaggacagccctaccgtagggcctcggctacgtacgttttaccgngggtaccaagttcccggtaaccccggggtaacgtccccgggggttacccctacggtaaccccgtatttccgaaggtcggtaccgacgggtccgggttactcggggacaagttactttccgaccttacctacctaaccactaccgaacgaccgtaaccggtcccttacgggccgtaaggtacccgttaggtaaacgaggtttcgggtacggtaccgtttaaggttttaacttttaagttacgttaactaaaacttaaactttaagtttatttaaccgttacgtttcggttagggttaacccggtttacgggaaccccgtaaaggggtaaccctaaagggggttccgtaagtaaccggttaccgaaacggtaccggtaaacgtttcgggg

SEQ ID NO: 279331 - DNA, 691 bp, Homo sapiens
  misc_feature: GYAE6OF02FOMZ7.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctcgtcgctcacctgtcncctacgtccgtccggggacaggacgtccgactacgacggactaggtgttcgtcgttcggctacgtgggtcacggcaccgtccagtcgagtacggtctaggtacggtcggacggtaggggaaacggtactacgtttatttaccgaagttcggtaacccaacgtaacggttaacgggtaaacttaaacttaaacgtttactacgacctacctaatttcggtaggtaggtacgtagtacgagtacgaacaaactaccggtaaacgtaacggactaaccgaactaaccggtaaacgtaacccgttagttacccgtacgtacgacacgttcgacttaccgtcttacggtccgtacccgacccggtaggacccggttaacggttactttaacggtaacctttaggaacgggtaacgggtaaaccgtcccggaaccccgttaaggtaccgtaaaccgg

SEQ ID NO: 279332 - DNA, 690 bp, Homo sapiens
  misc_feature: GYAE6OF02GP3PN.19.71.G05.1.454.CMB.1.raw
  modified_base (382)..(382): a, c, t, g, unknown or other
  misc_feature (382)..(382): n is a, c, g, or t
  modified_base (677)..(677): a, c, t, g, unknown or other
  misc_feature (677)..(677): n is a, c, g, or t
tcagtactctcgtgcacgaccggtgctcgatttagtgtcgtcgcaagagagagggggggaggtacaacaggcaggcaggggcagcaagatggtgttgcagacccaggtcttcattttctctgttcgctctggatctcgtgggtcgcccgacggggacagtcgtgatcgacccagtctccagacctcccgtggctgtgtctcggtggcgacggccgggccacagtaccaactcgacaacgtccacgacctaacgtacttttctttaacacctacgttaaccaaataacgttaaacgtaaaacttcgttaacgtccgtttacggaactacgtacgaggaacggaacctacggccacgtcctacgtaggctcgctactagttcgnggtctaacgtccggaccggtacgtcccggactagaccgtatcgaggtcgcgcgggtcggtgtaggacttagttccttaccgctaccgtaccgactacgcacggacttcgcgtgaccggtaggtactaggtaacgtggtcggtacgttatttacggttttattacgtacgtaaccttaaacttaagttactttaacgtacgtttacggttcggtaacgggtttaccgtaccgggaccggttaagggtacccggtaaggttcgaacttacgtaacggacgttaccggtcgtacgggntacgtacgacccg

SEQ ID NO: 279333 - DNA, 692 bp, Homo sapiens
  misc_feature: GYAE6OF02HGG64.19.71.G05.1.454.CMB.1.raw
  modified_base (340)..(340): a, c, t, g, unknown or other
  misc_feature (340)..(340): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaagccctcgcacgaccctctcgctccacctgtcgccatccgtaccggggacaggacgtcggactacgcgacaggttcgttgtcgttcggctacgtcgggtcaggccacgtccccatccggaggacggtcgtagngtgggcgtagggaacgtactattacgtttacagttacgtacccgaacgtacggtaggtaaactaacgtaaagtttacgtacgaccgtaccctagttcgttacggttaggaaccggtagtaccgacgtacgaacctaacgttaaccgaaacggttacaacctaaccgtaacgtaaccgaaacggtaacccttacggttacccctacccgacgtccgaacgttacccgtacggtacccttacggtcggttacccgtaccggtaccccgggtaaggtacccggtacgggttattaacgtttaacgttacgggttacggtacgggtaaccgaccgggttaccccgaagtaacccgg

SEQ ID NO: 279334 - DNA, 794 bp, Homo sapiens
  misc_feature: GYAE6OF02IMQ84.19.71.G05.1.454.CMB.1.raw
  modified_base (249)..(249): a, c, t, g, unknown or other
  misc_feature (249)..(249): n is a, c, g, or t
  modified_base (467)..(467): a, c, t, g, unknown or other
  misc_feature (467)..(467): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgaccctagtctccagacctccctggctgtctctcgtcggacgtaggccggtccacagtcactcgactacgtaccagcctaacgacttctttanactacgttaccaaactaataacgaaaacttacgttagacgttacgtaacacgactaagaacgaacgtagggaactacgtaccgttacgtacggctcgtaccgttactaagtttacgtggacctacgtaccgtaccggtacgtcccgggtctacgtaccgtattcgacgtaggctacgtcggaccgtaggaactcgtaactttcgactacgtacgaacncgtaacgtacgacgtaacgtcccgtaaggtacccgtagtaacccggtagtaaacgtacggttaccgggtacttaaacgttaacgttttaacgtaaaggtttacgtaaacccggttaaaattaaacgttttaacgttttaaaccgtttaaccggtttaacggttaaccggggttacgtaacccgggttttaccggaaacccggtttaaaacgggaacccggtttaagggggttaacccttaaacgggtttaaaccgtaaaccggttaaaccggtaacccggtttaaaaccgggttacggttacccggtacggtttacccccaaacggg

SEQ ID NO: 279335 - DNA, 759 bp, Homo sapiens
  misc_feature: GYAE6OF02H8ZV9.19.71.G05.1.454.CMB.1.raw
  modified_base (139)..(139): a, c, t, g, unknown or other
  misc_feature (139)..(139): n is a, c, g, or t
  modified_base (373)..(373): a, c, t, g, unknown or other
  misc_feature (373)..(373): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtncccgacggggacatcgtgatcgacccagtctccagtacctccctggctgtcgtctcgtgggcgacgcgggccaaccatcaacgtcgaccgtaacgtccacgccaactattacttttaactacctacgttaccaaactaatacgtaaaaaccttacttacgtcttaggtaacccagacaagtacgaacgaaggacacgtccttaccgtaggcctgtacctacttacgtttaccgnggactaactaccggtaacccgggacgttcccggggttaccacggtacgttacttaccggacggttacgggacggtaccggtaccggggtttacgacgggggtaaccctaaaggtttacttttacccaccgtttcctaaccgtacctagtaccgtacgacctaaccgtccgtaacggcgaacggttacgtacgggtaataccgggttgtaccggtttaactttaagttttacgttaacgttactaaaccgtaaattaaccgtttaattttaaaccgtttacgttcggttaacggttacggtaccgtttaaccggaccggtaaaggtccgggtaaggttagtaacttacgtacgacggtacgacggtttcggacgttacgcgtaaccg

SEQ ID NO: 279336 - DNA, 647 bp, Homo sapiens
  misc_feature: GYAE6OF02HCO82.19.71.G05.1.454.CMB.1.raw
  modified_base (247)..(247): a, c, t, g, unknown or other
  misc_feature (247)..(247): n is a, c, g, or t
  modified_base (454)..(454): a, c, t, g, unknown or other
  misc_feature (454)..(454): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggcctaccgatacgaacctgacaagtccagccactaattctttaanacagttaccaactaatagaaaactacttagtctagttaccagctagagaccaggaacacggcccttaccgtaggcttcgcctctatttactggggactacgtaccgacccggggtaatcccggggtacccttcgaccggtattcgacgtcggacgacggtcggggtctagggacctaaggtctttaccgacttctccgaactctacnggaccagcctacgcgaggtactaggaacgtagtcggtgacgtagtttattacttacgtactaaacgtaattaatttacgttaacttacgttacgttacgtaccggttaccggaacgtaacgggaccgttaagggtacggtaagttaacgtcgtaacggaaccggttacgttacggtacgtccgtagtaccccg

SEQ ID NO: 279337 - DNA, 648 bp, Homo sapiens
  misc_feature: GYAE6OF02IL66D.19.71.G05.1.454.CMB.1.raw
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (344)..(344): a, c, t, g, unknown or other
  misc_feature (344)..(344): n is a, c, g, or t
  modified_base (610)..(610): a, c, t, g, unknown or other
  misc_feature (610)..(610): n is a, c, g, or t
  modified_base (640)..(640): a, c, t, g, unknown or other
  misc_feature (640)..(640): n is a, c, g, or t
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtcgcccaggggacatcgtgatcgacccagtctccagacctcccgtggtctgtcgttctcgtgggcgaggccgggccaccatacaactgacagtccagccaatattctttanacacgttaccaataatanaaacttacgttagtcttacggtacagactagacgaccaggactacgcctacgtaggctacgtctactagtttaccgngtcacttacccggtaaccgggtacgtccgggtccacgtaaccgttgtacggtgtacggcgtacgggtcggaaccgtgggaactacgttactttccgctaccgtaccaacctacgacgaacgtacgtacgtacgtcgacgtacgggtctacgaaacgttgtaacggtcggttaataacgttttagttaacttacggtaaacctaaagtttaactagtttaacttacgttactcggttagtacggttacgacgtaacggaaccggtancgtaatacgtgacgtacgacgtaggtaccngtcgtaac

SEQ ID NO: 279338 - DNA, 658 bp, Homo sapiens
  misc_feature: GYAE6OF02F4XBI.19.71.G05.1.454.CMB.1.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (651)..(651): a, c, t, g, unknown or other
  misc_feature (651)..(651): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacgggacatcgtgatgacccagtctccagactccctggctgtgtctctgggcgaggcgggccaccatccaactcgcaagtccagccacaattcttttaanacagttaccaaacaatagaaaactacttagcttggtaccagcagacgacagacacgcctctacggctcgctactatttacgngggactacgtaccgtaacccggggaacgtcccgggggtccctacggaccgtacttacgaggtcggacgacggtcgggtcgtaggggaacctaggtaactttccgacgttcctacccacctacgttacgaacgaccgaagtcccttaggaccgtaggactaggaacgtagtacggtaggtacttagttttaattagtacgttaactaaagttacttaaagttttattaacttaccgtttagtcgggttaccgtttaccggaccgttaacgggaaccgttaaggttacggtaatacgtacgtaacggacgtacgtaggtggtaccgtntaacccg

SEQ ID NO: 279339 - DNA, 864 bp, Homo sapiens
  misc_feature: GYAE6OF02I0QZI.19.71.G05.1.454.CMB.1.raw
  modified_base (120)..(120): a, c, t, g, unknown or other
  misc_feature (120)..(120): n is a, c, g, or t
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
tcagtactctcgtgcacgaccggtgctcgatttagtgtcgtcgcaagagagaggggggaggtacaacaggcagggcagggggcagcaagatggtgttgcagacccaggtcttcatttctntgttgctctggattctcgtggtcgacccgacggggactatcgtgatcgaccctagtcctcacgacctccctggctgtgtctcgtgggcgnggcggccacagcactgtacagtccacgaccactacttcttacactacgtaccaanaacgtaactaaaacctacgttaacgtcgttaccggtaaccgagacaggtaacgaccgaacggacgtaacgcccttacgtcgggtactccgtaccgttacgtaccgttaccgtacggggtactacgttaaacccggttacccccgggggtaaacgttacccccgggggggttccctacgggttaacccgtttaacggttacccggtacggtttaccggggaacgtttccgggaacggggtttcccgggttaaacgggtaacccgtacgggttaaaccttttcgttaaccccgtttacccggttacccttaaccccggtaaaccttcccgaggtaacccggtacggtacccgtttaccggaccggtaacggtaccgtaaacggaaccgttgggttacggtccgggtttagtttaacgggtttaacctttaacggttctaaaaccctaaacggttaaattaacttttaacgtttaaactaaccggtttacgggttaccggttaacggttacccgggtaacccgggtaagtaacccgggtaaggttacccggtaattacggaacgttcgggtaacctggttaacggcggttacgccgttaacg

SEQ ID NO: 279340 - DNA, 846 bp, Homo sapiens
  misc_feature: GYAE6OF02FL7BH.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacagtcgtgactcgacccagtcctcacgacctcccgtgctgtgtctcgtgggcgacggccggccaccgataccgaacgtgaccgaacgtccacgtacccaattacttacttttaacacctacgttaccaaactaataacgtaaaacctttacttacggtacttttacggaccagtactaacggacgaacccggaggtaacccgacggtccccttaccggtaacggccttacggtacctttacttaccgttttacggcgggtaactacggttaccccggtaacccgggtaccggttccccggggttaccaccggtccgttaagttccgacgggtcggaccgtacggggtccggttacggtacgggaacttacgttacgtttaccacccgttccgtactaccgtacgtaccggactaccgaccgtccgtacgacggtaccggttacgttacggaaacggtttcggtacgggttcgttaacgttttaacgtttttaacgttttaccgtaacgttaacgtaaaccttttaaaggtttacttttaacgtttaaccgtttaccggtttacgggttaccgggttaacccgtttcggggaacccggttaacggttaaaccgggtagggttaacggttaacgttacgtaacccggaaggttacccgttaaacggtttcgaaccgggttcgttaaccgtaccccg

SEQ ID NO: 279341 - DNA, 727 bp, Homo sapiens
  misc_feature: GYAE6OF02GIMOA.19.71.G05.1.454.CMB.1.raw
  modified_base (222)..(222): a, c, t, g, unknown or other
  misc_feature (222)..(222): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacagtcgtgatcgacccagtcctccagacctcccgtggctgtgtctcgtgggcgagccggaccaccatcaactnaccgaacgtccacgaccaataacttcgttttacaactacgttccaaactaagtaacgaaaaacttacgttaacgtcgtttacggtaaccgagtcgaaggaacgaacccgaacgggtaacacggtccccgttaccgtaagggcctagctacgtaattttacgcgggtacctactaccggtaaccccggggtaacgtccccggggttacctcggaaccttcttacgacggtccgggaacgtcggtcggggttacacggggactaggtacgtttaccacgtctacccactactacgacgtacgaccgtccgtacggccgtacggaccgttaggaacgttcgtggttcgtacttttaagttttaacgttagttacgtaactaaacgttatttactttatttacgttaacgttcgttacgggttaccgtacgggtacggtaaacggtacgtaacgggttcgaattaccgacggtaacgtacgtaaccgttggtcggtacgtacggtaccc

SEQ ID NO: 279342 - DNA, 769 bp, Homo sapiens
  misc_feature: GYAE6OF02FVJQI.19.71.G05.1.454.CMB.1.raw
  modified_base (259)..(259): a, c, t, g, unknown or other
  misc_feature (259)..(259): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtcgtcctgtcacaagtaccagctgcagcagtcaggtccaggactggtgaacgccctcgcacgacccctctcgctcacctgtcgcctatccgtccgggganagagtcgctacgcgacagtgttgcgttcggcgcgtgggtcaggcacgtcccagtcgagacggtctaggagtggcgtagggaacggactattagtttcaacgttcgtacccgtaaacgtaccgggttaggtaaaacgttaaccttaaaagtttacgtccggtaaccctaacccgtaacgttcgtttaacggtttaggtaacgtaaaccgttacggtacctaaggtaaaccctaacgtaacgtaaaccgggtaacgtaaccctaacgtaaccgtaaccggaaacgtaaaacccgtccgttttaccctacccgttacggtaccgacggttaccctaccggtttaacccttaccggttaccggttacccgtaacccggttaccccgggtaaaccggggtaacccgggtttaaacggggtttaacctttaaacggtttaaccggtttaaccgggtttacgggttaaacgggtaaccccggtacccgggttaacccccccgttaaggtaaacccgg

SEQ ID NO: 279343 - DNA, 666 bp, Homo sapiens
  misc_feature: GYAE6OF02GYVVV.19.71.G05.1.454.CMB.1.raw
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctcgtgggcgaggcggccaccatcaactgcaagtccagccaactaattctttaanactacgttaccaaactaataagaaaacttacgttaagcttaggtaaccagtaccaggtacgaaccgaggacacggtccctacgtacggctcgcctactacgtttacgngggtctacgttaccggtacccgggtaacgtccccggggtccctacggtaacccgtagttccgagggttacgcgtacgggccgggtcgtacgggactaggtacttttccgacgtacctaccgtaccgagtccgtacgccgtgtccgtgacgtacgggacttagacgtagttcggagtacgtttaacgtttagttagttacgtaacctaaattacgtttaatttctttaacgttacgttacggtacgtacgttccggaacggtacgggtaacgtaggtagtactagaacacggtacgtacgttggcggtactgtaccc

SEQ ID NO: 279344 - DNA, 681 bp, Homo sapiens
  misc_feature: GYAE6OF02HK9ZO.19.71.G05.1.454.CMB.1.raw
  modified_base (241)..(241): a, c, t, g, unknown or other
  misc_feature (241)..(241): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatcaactgacaagtcagccacaattcttttanactacgttaccaaactaatacgtaaaacttacttagtcttaggtaccagcaagacgaccaggacagcctaccgtaggctgactactacgtttacgnggacacgtacgacccgggaacgtccgggcctacgacgtnttacgngtcggcgtacgggcgtacgtaggacgtagtactttcgacttcctacactacacgacgtctagaccgttgaccgaacggtcggtaacgaacggttagtacggtacggtaacgtttagttttaacgttacgtttacgtaacgttaaacgttaagtttaattttaaattaaacgtttacgtttacggttacggggttaaccgtttccggggaaaccgttaacggggtaacggttaacgggttaggtaacgttaacgtacggtaaccgtaacggttaacgtccgggtagttccggtaaggccc

SEQ ID NO: 279345 - DNA, 647 bp, Homo sapiens
  misc_feature: GYAE6OF02JVSPR.19.71.G05.1.454.CMB.1.raw
  modified_base (250)..(250): a, c, t, g, unknown or other
  misc_feature (250)..(250): n is a, c, g, or t
  modified_base (428)..(428): a, c, t, g, unknown or other
  misc_feature (428)..(428): n is a, c, g, or t
  modified_base (469)..(469): a, c, t, g, unknown or other
  misc_feature (469)..(469): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagacctccctggctgtgtctcgtgggcgaggcggcctaccgatcaactgactaacgtccagccaactaatttctttanactacgttacccaaagtaataagtaaaaccttacttacggtacttacgggtacccagactacgaagaacccacggaccagtcccttacgacggtgtacgctactagtttacgtcggactacgtaccggtaccgggtaaccggtcccgggtaccctgtaaccgtattcgagtcggacgngggtcggtcgtacgggactagtactccgactctacaccgtnacgcgacgctcgtcgcgagtactggtaacgtcgtggtacgtacgttaagtttaacgtttacgtgaacctaatacttattattacgttgttacgtcggtaccgtacggaccgtacgggtaacggtacgttaggacttacgtacgaacgttacggacgttggtaaccgtcgtacgtaccg

SEQ ID NO: 279346 - DNA, 640 bp, Homo sapiens
  misc_feature: GYAE6OF02JO5BH.19.71.G05.1.454.CMB.1.raw
  modified_base (166)..(166): a, c, t, g, unknown or other
  misc_feature (166)..(166): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
tcagtactctcgtgcacgaccggtgctcgatttagtgtcgtcgcaagagagagggggacggtacaacaggcaggcaggggcgagcagatggtgttgcagacccaggtcttcatttctcgtgttgctcgtgtatcgtctcggtgacccgacggggtacatccgtagntcgacccagtcctaccaggactcccgtggctgtgtactctgggcgcgcggcctacgatcgactganacgtcgaaccgntattcgttacaacgtcgttaccgtaacaactggtaaaacctacctagtaccggttatccggaactcaacgacgtacgacgctagccctacgtacgnttcaccgttnaagtttcgacgntaacgcgtacgcnccggtacnggaccntagtcgngtcgngtcgtcganacggntaccttagtcccgtctaccgtcgttacactgtcctagtccgtaggctacggacgtaccgtagtaacggtcgtacgtcgtagttagtaaccgttgtaacggtacctaagtttagttcgttacttcgtaaccggtaccgtttacgggacctacggtacgtaaccggtacgttaacggtacgttacgtataacggaacgttacgacgtaccggtcgttaccgtaccgg

SEQ ID NO: 279347 - DNA, 806 bp, Homo sapiens
  misc_feature: GYAE6OF02GISC9.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggactctcgtggtacgccccgacgggggacagtcggtgatcgacccctagtcctccagacctcccgtggctgtgtcctcgtgggcgacggcgggaccacatacctaactcgaccaacgtccgaacgacccaactaatttcctttaacactacgttacccaaataaataacgtaaaaccgttacttacgtaccgtttacggaacccgagtacgaaggaccgaacccgaaggaccacggtccctaccggtacggcctcgtacctacgtacgttttaacggcggaactaccggttaccggtaaccccggggtaaccgttccccggggtacccgtagtaacccgttatccggtaggttccggacggcgggtcgggtacggacgggtacgtaagttcccgttacgacccttctacccgtaacctacggttaccgacgccgaacgtacccggtgaccgggtaaccggtgttaacgagttacgtaacgggttcgtacgtttagggttttaacttaaggttacgttaaaccgttaattaagttttaacgttttaacttaacgtttaccgtttgggtaaccggttaccgttacgggtaaccggtaacgggtaacccggtaagggttcggttaaagttaccgaacggttaacgggtacgtaccggtacggttcgtacggtccctaaccg

SEQ ID NO: 279348 - DNA, 604 bp, Homo sapiens
  misc_feature: GYAE6OF02JZS66.19.71.G05.1.454.CMB.1.raw
  modified_base (250)..(250): a, c, t, g, unknown or other
  misc_feature (250)..(250): n is a, c, g, or t
  modified_base (448)..(448): a, c, t, g, unknown or other
  misc_feature (448)..(448): n is a, c, g, or t
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
  modified_base (552)..(552): a, c, t, g, unknown or other
  misc_feature (552)..(552): n is a, c, g, or t
  modified_base (599)..(599): a, c, t, g, unknown or other
  misc_feature (599)..(599): n is a, c, g, or t
tcagtactctcgtgcacgaccggtgctcgatttagtgtcgtcgcaagagagagggggtcaggctggaactgaggagcaggcaggggcagcaagatggtgtgcagaccaggtcttcatttctctgttgctctggatctctggtcgcccgacggggacatcgtgatgacccagtctcagactccctggctgtcgtctcgtgggcgaggcggccacactcactcgcaacgtccacgccactaattccttttanacgtacttaccaactaatacgaaaacttcttaagtcgttacggacctagccaaggtacgacacggacacgtccctacgtacggtctcgaccttactacgtttaacggtgggacctaacggtcccgtaaccgggtaaccggtccggggtacctacggaccgttactagacgtcggtacgcggtcggggtcgtggtaacngttacttcgtactcgtcacgtaacncgtagcacgtcncgcgaggtcaagacggagttcgagtagtttattacgttgtacgttaataaacttgtaattattcgtntacggtcgtacgtacgcggtaacggagtacgtgactatggactacgngtagg

SEQ ID NO: 279349 - DNA, 837 bp, Homo sapiens
  misc_feature: GYAE6OF02JH24H.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgacccgacgggacatcgtgatgacccagtctccagacctcctggctgtgtctcgtgggcgagccgggccaccactcaactcgacacgtccacgaccactactttctttactacgtacgttaaccaactaactaacgaaaacttattacgtacgttacgtaacccgagacgaacggtacgaaccgtacggacctacggtccctaccgtagggccttacggtccttaacgttacgtttacggtacggacctaaccgttacccgggtaaccccgggtaacccgggttccccggggttacccctacggtaaacccgtagttaccgtacggtccgggtacgtacggggtccggttcggaacgggtacgaccgtttacgtttaccaccttaccgtacccgtaaccgtagtaaccgtaccgggaccctacgggacccgttacgaccggtaacggttaccggtaaacggtaaccggttagtaccgggtttaaggtacgttttaaacgtttttacgtttaacggtttacgttaaacccggttaaactttaaacgtttaactttaacgtttttaccgttaacggtttaccgggttaacgggttaccgggtttaacccggaaaccggggtaaaccgggttaacgggtacggtttaaccgggttaacgaccggtttaagaacgggttaaccgttaacggtacggg

SEQ ID NO: 279350 - DNA, 847 bp, Homo sapiens
  misc_feature: GYAE6OF02IYIC3.19.71.G05.1.454.CMB.1.raw
  modified_base (510)..(510): a, c, t, g, unknown or other
  misc_feature (510)..(510): n is a, c, g, or t
  modified_base (536)..(536): a, c, t, g, unknown or other
  misc_feature (536)..(536): n is a, c, g, or t
tcagtactctcgtgcacgaccggtgctcgatttagtgtcgtcgcaagagagagggggggaggtacaacaggcaggcaggggcagcaagatggtgttgacagacccaggtcttcatttctctgttgctctggatctctggtcgcccgacggggacagtcggtgatcgaccctagtcctccgagacctcccgtggcctgtcgtccttcgtcgggacgacggccgggacctaaccgaacgtaccgtaactgaccgtaacgtcccgagacccaacgtaacttactttaacgtaacaacgttacccaaacaaagttacgtaaaaaccttacttaacggtccgttaaggtaacccaaggtaccgaacggtaaacgacccgtaaggaccgaaccggttacccttaaccgtacgggtcctacggtacctaacgttaactttaaccggcgggtaacctaaccggttaccggtaacccgggttaccgtcccggggtacccctaagtaccgtacgttacgnggtaccggcgacgggtaccgggttanacggggtaactcggttaatccctaacgttacctaccggaaactaccgagttaaaccgcggtaaccgtcgtacggtacccaggtacttaaacggagttacgggtacgtaaccggtagtttaaacgtttacgtaagtttaccggtaaataacgttaaattaacgttaacttaacggtttaccgttacggttccgggttaacgtaccgggtaaacggtaaccgggggttaaaccgtacgggtaaccgtaagttaaccggtttaccgaacgtaacgggttaccgttaagggtaccccgttaggtaccgtaacccg

SEQ ID NO: 279351 - DNA, 943 bp, Homo sapiens
  misc_feature: GYAE6OF02HT56A.19.71.G05.1.454.CMB.1.raw
  modified_base (117)..(117): a, c, t, g, unknown or other
  misc_feature (117)..(117): n is a, c, g, or t
  modified_base (215)..(215): a, c, t, g, unknown or other
  misc_feature (215)..(215): n is a, c, g, or t
tcagtactctcgtgcacgaccggtgctcgatttagtgtcgtcgcaagagagagggggaggtacaacaggcaggcaggggcagcaagatggtgttgcagacccaggtcttcattttcnctgttgctctggatctctggtcgcccgacggggacagtcgtagattcgaaccctagtcctaccagacctcccgtggctggtcgtcgtcgtcgggacgngggccggtaccacctactaccaacgtcggaccaacggtccaacgaccctaactaacttcctttttaacactaccggttaaccaacgtaaactaacgtaaaacttacgttacgtacgttacgtaaccacggtacacgaacgtacccgaacggaaccgtaccgtaccgtaccgtacggtactcgaccttaccgttaacgtttaacggtcggtaaccgtacgttaccccggttaaccggggtaaccggttcccgggtacccgttacggacccgtacgttaccgtaggttcgggaccggtaacggggtccgggttacggtacgggtacgtaacggttaccgttttaccgacctttccgaaccgtacccgtaactaaccgtacgggtaccctacggtaacccgttcggaccgggaaccggttacggtaaacgggtaacgggtaacggtttaaccgggtacgggttaaccgttttaacggtttttaacggtttaacttttaacgggtaaaccctttaaaacgggtttaaacttttaacgtttaaacgttttaaacggtttaaccgggtttaccgtttaacggggtttaaccccgggtttaaccggtaacccgggttaaaacgggttaacgggtaaacgggtttaaacgtaacggtttaacccgaaggtttaaacgggaaccggggtttaaacgttacccgggggttaagtttacccggtaccgttaaaccccgg

SEQ ID NO: 279352 - DNA, 815 bp, Homo sapiens
  misc_feature: GYAE6OF02GV7ZS.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctcgtggtcgcccgacggggacatcgtgatcgacccagtctccagacctccgtgctgtcgtctcgtcgggcgacggccggaccaccactaccaacgtcgaccgtaacgtcccacgacctaactaatttactttaactactacgttaacccaaataaactaacgtaaaaccttacgttacgtaccttacggtaacccaggtaccgaaggaacgaccgaaggaccacgtcccgtaccgtaggtccttcgaccttacgttaacgtttacggacgggtacctaccggttacccggttaaccccggggtaaccggtttccccggggttacccgtacggtaacccgtacgtttaccggacgggttaccggccggtacgggtcccggggttacggtaacggggtaacctaacggtttaccgttttacccgaaccgttccgtacccgtaaccgtacgttaccgacggtaccgtaccgtaccgttacggaccgtacgggtacgtaaggtaacggtagttacggtacggttaacgtttagttttaacgttacgttacgtaaaccttaaagttaactttaacgtttaacgtttacgttacgtttacgggttacgggtaaccggtttaccgaaccgggtaacgggtacgttaaggtcgtaacgttagaaccggtacggtacgtcgtacgg

SEQ ID NO: 279353 - DNA, 725 bp, Homo sapiens
  misc_feature: GYAE6OF02IU3K3.19.71.G05.1.454.CMB.1.raw
  modified_base (510)..(510): a, c, t, g, unknown or other
  misc_feature (510)..(510): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtcgtctcgtcgggcgacggcggccaccacgtcaactgcaacgtccagcccaataacttctttaacactacgtaccaaacagtaacgtaaaacttactagtccttaggtacccagtcaagtacgaccaggaccacgaccctacggtacggcttgcctactacgttaccgtggaccacgtccgtaacccgggtacgtcccggggtacctacggtccctagtcgtaggtcggtacgacggtcggtacggtacgggactacggtactttccgactccgtaccacctacgtaccgtaacgaccgtacggtacctcgggtacacgggtnttaaacggtaaggttacgttaggtacggtaacgtttaaggttttaatttaccggttagttaaacctaaacgttaagtttaagtttaactttaacgtttacgtaccgttacggttaccggttcccggaacgtaaaccggggtccttaaaggggcggtaagtaaccgtaaacggtacggtaaccgttaacggtcggtacggtacccgtacgtaaccg

SEQ ID NO: 279354 - DNA, 722 bp, Homo sapiens
  misc_feature: GYAE6OF02F0BIT.19.71.G05.1.454.CMB.1.raw
  modified_base (489)..(489): a, c, t, g, unknown or other
  misc_feature (489)..(489): n is a, c, g, or t
  modified_base (609)..(609): a, c, t, g, unknown or other
  misc_feature (609)..(609): n is a, c, g, or t
  modified_base (623)..(623): a, c, t, g, unknown or other
  misc_feature (623)..(623): n is a, c, g, or t
  modified_base (708)..(708): a, c, t, g, unknown or other
  misc_feature (708)..(708): n is a, c, g, or t
  modified_base (715)..(715): a, c, t, g, unknown or other
  misc_feature (715)..(715): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgtgctctggatctctggtcgccgacggggacattcgtgatcgtacccagtctcagacctcctggcttgtctacgtcgtgggcgaggccgggccacgatccgaacgtcgactaacggtccaacgccaactactttcttttaacgaacgtacgttaccaaacgtaataacggtaaaaaccgtttacttaacgtccgtttaagtaaccgagtaccgaaacggacgaccaaacggtaccgtacgtcccgttaacgtacgggtaccttacggaccttacgttacgtttacggtacgggtccaacggttttccggaaccccggtaagggttccccggggtaccctggaaacccgtgttacaagggtttcggaccngggttaccgggtacgttcggaactacgttacctttacggctccgtactacgacacgtacacggtacgacgtagaccgacggtacttaaggagtaggttaacggcgtaagtttaacggttnttaacgtacgttanaacttaattactaattacctaggttcgacgttaggacgtacgaaggtaccgaggtaagtacctgtaacgacgtaatacgttcggngttaccngtaaccc

SEQ ID NO: 279355 - DNA, 808 bp, Homo sapiens
  misc_feature: GYAE6OF02G3ZCK.19.71.G05.1.454.CMB.1.raw
  modified_base (188)..(188): a, c, t, g, unknown or other
  misc_feature (188)..(188): n is a, c, g, or t
  modified_base (247)..(247): a, c, t, g, unknown or other
  misc_feature (247)..(247): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccgacggggacatcgtgatcgacccagtctcacgactcctggctgtntctcgtgggcgacgcggccacatcaactgacaacgtccacgccaactaacttctttaanactacgttaccaaataataacgtaaaacttacttagtcgttacggtaaccagtacaaggtaacgaaccgtaagggaacctacgtcccttaccggtacggtctcgtaccttactaacgttttacggacgggtacctacgttaccccggtaaacccggggtaaccggttccccgggggtaccctacggtacccggtattccggacgggtacgggtaccgaccgggtcgggtaccggtacgggtaaccgtagttacctttacgtcctacctacccgactacgtacgacgtacccggtaacgtccgtacgggaccggtacggtacggttaacggtaacgtacggttacggtacggtttaaccgttttaaaggttttatttaaccggtaaccttaacgttaaaaccttatttaacttttaagttaccggttttacgttaacggggttacgttaccgggtttaccggaacccggtttaaaacgggggtacccttaaagggggtacttaacgtacctaaagggtacgtaaaccggtggtttaacccgggtcggacgttaccggtaacc

SEQ ID NO: 279356 - DNA, 276 bp, Homo sapiens
  misc_feature: GYAE6OF02IVUER.19.71.G05.1.454.CMB.1.raw
  modified_base (240)..(240): a, c, t, g, unknown or other
  misc_feature (240)..(240): n is a, c, g, or t
  modified_base (244)..(276): a, c, t, g, unknown or other
  misc_feature (244)..(276): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctcctggatctctggtcgcccgacgggacagttcgagactcggacccagttctccgagtacctccccgtggcttggtcgtctcggtggacgaggcgggctaggcaagggctcagtgnatgnnnnnnnnnnnnnnnnnnnnnnnnnnnnnnnnn

SEQ ID NO: 279357 - DNA, 755 bp, Homo sapiens
  misc_feature: GYAE6OF02HYUBW.19.71.G05.1.454.CMB.1.raw
  modified_base (270)..(270): a, c, t, g, unknown or other
  misc_feature (270)..(270): n is a, c, g, or t
  modified_base (745)..(745): a, c, t, g, unknown or other
  misc_feature (745)..(745): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgacggggacagtcgtgatcgaccctagtcctaccagacctcccgtggctgtcgtctcgtgggcgacggccgggaccactactaccgaacgttcgaccacgtaccgacgccaaactatttacctttaanaccgtacgttaccaaacgtaacttaacgtaaaacttacgtacggtaccgtttacggtaaccgaagactaacggaaccgaccgtaacggaccctaccgtaccctacggtaacgcgttacgtaccttacgtaacgtttacgcgggtactacgttaacccggtacccggggtaccgttacccgggtcccgtacgtacccgtacgttcaacgggtcggtaacgcgggtccggttccgtaggtacgtacgtacttttacgaccttcgtaccgtacctacgttaaccgacgccgaccggaccgtacggaccgtaacggtacgtaacggtaccggttagtccggtaagttacgttacgtttaagtacgttagtaacttaaacgttaattacttaacgtttacgttacgttaggtaccgtaccggtacgtaccggtaagaacggtagtcgtaagtacgtacgtacggtaccgtgttacggacncggtactacg

SEQ ID NO: 279358 - DNA, 685 bp, Homo sapiens
  misc_feature: GYAE6OF02IN2QW.19.71.G05.1.454.CMB.1.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (519)..(519): a, c, t, g, unknown or other
  misc_feature (519)..(519): n is a, c, g, or t
tcagtactctcgtgcacgaccggtgctcgatttagtgtcgtcgcaagagagaggggggaggtacaacaggcaggcaggggcagcaagatggtgttgcaggacccaggtcttcattttctctgttgctctggatctctggtcgcccgacggggacatccgtgatgacccagtctcagactcccgtggctgtgtctcgtgggcgaggcggaccacatcaactgactaacgtccagccaacaattctttanactagttaccaaanaatacgaaaacttacttagtacttacggtaaccagtcaggacgaaccaggaaccacggtcccgtacgtagggcctacggacttaccttaagtttaccgtcggggactaaccgttacccgtacccggggtaaacgttccccgggggtaccctaggtaacccggttattaccggaggtcggacgtacggtccggggtacgtaggggaactaggtacttttccgacgttacctacgaaccgactcgaacgtcgacgtccncgacgtacggtctagaacgtagtcggtcgtcttaaggtttattacgtacgtactaaactaagttacttaatttacgttactggttaggtaccgttacggacgtaagggaaccgtagggtacgtataactacgtaacgaccgttagtacggtggtaccgtgaacccg

SEQ ID NO: 279359 - DNA, 726 bp, Homo sapiens
  misc_feature: GYAE6OF02J2SJH.19.71.G05.1.454.CMB.1.raw
  modified_base (153)..(153): a, c, t, g, unknown or other
  misc_feature (153)..(153): n is a, c, g, or t
  modified_base (420)..(420): a, c, t, g, unknown or other
  misc_feature (420)..(420): n is a, c, g, or t
tcagtactctcgtgcacgaccggtgctcgatttagtgtcgtcgcaagagagaggggggaggtacaacaggcaggcaggggcagcaagatggtgttgcagacccagttctcatttctctgttgctctggatctctggtcgcccgacggggactntcgtgatcggacccagtctcccacgtacctcccgtggctgttctctcgtggcgaggccggaccacatccaagtcgacacgtccacgccaactattcgttttacacgtacttacccaataacgtacgtaaaactccgtagtcgttacggtaccaggtcaacgacgaaccaggcacgtcctacgtgcctgtctcgtacgttacgcggtacctacgtaacccggtacccggggtaccgtccccggggttacaccgaccgttacgttccgnggttcgcgtaacggtccggggtactaggggtcctaagtttcgtttcccaacgttcctcccgaccgtacgcgtaccgacgtcgacctcggacggtacgaggttaaccgaagttggtccgtagttccttaagttttaccgtacttacgaacttaaaccttagtttatttaaacgggttacttacccggttagggtacggtacccgggtaccgaaccggtttaaacgggggccgttaacgggttagtaaccgtacggtaacggttaccgggtacttaaccgggttggttaaccggcggtctaacccggg

SEQ ID NO: 279360 - DNA, 803 bp, Homo sapiens
  misc_feature: GYAE6OF02GCM8T.19.71.G05.1.454.CMB.1.raw
  modified_base (181)..(181): a, c, t, g, unknown or other
  misc_feature (181)..(181): n is a, c, g, or t
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgcgtggcctcccacaaggtgtcctgtcacaagtacagctgcngcagtcaggtccaggactggtnaacgccctgcacgccctctcgactcnctgtcgcctactccgtccgggacaggacgtcgacgtacgcgacgtagtgttgtcgtggacgtacggtcgggtacacggcgtaccgtaccccgagtcgtaacggtcggtacgtaggtacgtcggtacggtaggggaacggtaacgtactttaagtttcgtaacgtttacggtaaccgaaacggtaacggtaacgtaaaacgttaaacctaaaagtttaccgtacggtaacccaaccttaagtttccggtttaagttaaggggtaaacgtaaccggttacgtaacgtaaacggtaaacctaaacgttaaccggaaaacgttaccggtaaacctaaacggttaaaccgtaccggtaaaaacccggtaaacccgttaccgtttaacctccccggttagtaaccgtacggttaccgttaacgttacccgttacgtaccgttaacggtaccccgttaccgggtaaaccgggtaaccgggttacccgggtttaagttaaacccgttttcgttaaacccgggtaggggtttaaccggaaacccgggtaacccgtacccccgttaaggggaccttaacccggg

SEQ ID NO: 279361 - DNA, 860 bp, Homo sapiens
  misc_feature: GYAE6OF02G3R8V.19.71.G05.1.454.CMB.1.raw
  modified_base (131)..(131): a, c, t, g, unknown or other
  misc_feature (131)..(131): n is a, c, g, or t
  modified_base (249)..(249): a, c, t, g, unknown or other
  misc_feature (249)..(249): n is a, c, g, or t
tcagtactctcgtgcacgaccggtgctcgatttagtgtcgtcgcaagagagagggggagagtctgctgaattctggctgacagggcagtcaccagagctccagacaatgtctgtctccttctcttcttccngtcccgtgtcgtcggggtccctacccaacgtaaggttcgtccttgtacaactaagtacagctgacagcagtcgacgtcaaggacgttggagtaacgcccgtcgactacgtacccttcnccgtacctcctaccggttcgtcgaccacgttacccgggtaccgggaacgtacggtacggttcccgtaacgtacggaccgttaacgtacgggttgtttaccggttcggtttaccgggccgtttaaccgggttcgggggacgtaccgggtaccgtaacccggtccccgtaggtcggtaaacgggtcggttacgtagggttggacggtaccgggagggggtaaacgtactacggtttttactacgaaacttccgtaaaacgtaacggacggttaacggtaaacttaaaccggtaaatttacgacgttaacccgtaaccgtaacgtttccgttagggtaacggtcgttaaccggaccttaccgggtaataaacgtaccgtaacggtaaaaccgttaccgaaaccgaacgttaaccggtaaagtaacccttaaaccggtacccgtttaccccgtacgttaacgtcccgtaacgttcccgttaccttaccggtacgttaacgtacccggttacccggtacccggaaggtttaaccgggtaacggttacgtttaagttaaccgttgggttaaccgtcgggaaacccggtttacccgaccggttaacttacgggtaacc

SEQ ID NO: 279362 - DNA, 835 bp, Homo sapiens
  misc_feature: GYAE6OF02H3VT4.19.71.G05.1.454.CMB.1.raw
  modified_base (88)..(88): a, c, t, g, unknown or other
  misc_feature (88)..(88): n is a, c, g, or t
  modified_base (214)..(214): a, c, t, g, unknown or other
  misc_feature (214)..(214): n is a, c, g, or t
tcagtactctcgtgcacgaccggtgctcgatttagtgtcgtcgcaagagagaggggggaggtacaacaggcaggcaggggcagcaagntggtgttgcagacccaggtcttcatttctctgttcgctctggatctctggtcgcccgagggacagtcgtgatcgaccagtctccagcctcccgtggctgtcgtctcgtgggcgacggccggccacntacaatgacacgtccacgacctaacttactttctttaacgtacctaacgttaaccctaaataaaacgttaacgtaaaaacccctttacgttaaccggttaccggtttaacgggaaaccccaggaacccgacggacccggtaaaccgacgggtaacctaccggtccccgttaccggtaagggtccttacgtccgtttaaccgtttaggtttaccggcgggtaacctaccggttaaccccgggtaccccggggttaacgcccccggggttaccctaacgggtaccgttagtccggtcgggtccggtacggtacgggtccgggtacggttacgggaaccgttaacgtttaccttttacccgtacccgtacctaccgaccgtaacctcggaaccgtaccgtcgtacccgtagggtacccgggtagtaccggttgggaaacgttggtacggtttcgtaagttttatttaaggttacgttacgtaaaccttaagttaaacttttagtttacgttaccggttacggttccggtaggttaccggtccggtaacgggaaccgttacgggtaaagttcgtaaagtaccgtaaggttaacggacgttacggttccggtacgccgtaccgtac

SEQ ID NO: 279363 - DNA, 668 bp, Homo sapiens
  misc_feature: GYAE6OF02JJ1Y2.19.71.G05.1.454.CMB.1.raw
  modified_base (228)..(228): a, c, t, g, unknown or other
  misc_feature (228)..(228): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctcagactccctggctgtcgtctcgtgggcgacggcgggccaccatcaactgcaagtccancctaacatttcttttaaataacgttaccaacgaatagtaaacttatacgcttacggtaccagcagactaccgaggaacacgtcctcgtagcctcgactctaagttttcgcggtactacgtaccggtacccggggaaccgttccccgggtaccctacggaccgtactttacggaggtacggcgtacggccggttgcggggtaactacggtaacttttccaacgttcccgtacctaaccgtcgttacgacggacctacgtccgtcggactacgggtactaggacggtagttcggtgtacgtttatttacgttagttacgttacaaacttaattaactttacttacttacgtttcggtaggttaccggttacggtacgaacggtacggtaggtacggtattcacgtaacgtacgttaacggtcgcggtacgttgacctaaccg

SEQ ID NO: 279364 - DNA, 862 bp, Homo sapiens
  misc_feature: GYAE6OF02IPAOM.19.71.G05.1.454.CMB.1.raw
  modified_base (184)..(184): a, c, t, g, unknown or other
  misc_feature (184)..(184): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctacccacaaggtgtccctgtcacaagtacagctgcancgagtcaggtccaggactggtagaacgccctacgcacgaccctctccgcctccacctagtcgacctacgtccgtaccggggacagacgtcgcgacgacgacaggtgttgtccgtttggactacggtcggtacgaggccgtacgtaccccagtacgagtacggtacgtacggaggtcggcgttacggggaagtacgtacgtttacttacgtacgttacgtacccgtaaacgtaacgggttaacgtaaacttaaacgtaaaagttttaagtaaccggtacctaaaccgtttaacgtttacggttaccgggtttaaaggaaaccggttaagggtaccggtaaccttaaacggtaaacgtaaaccgtttaaacggtaaaaccggtttaccgaaaaaccctttaacgaaccggtttaaaacccggtaaaacggttaaccccgtttaaacccggtttccgttaacccccgtaaggggttaccctaaacggttacccgttaacccggtaacccgtttaaaggttaccgggttaacccggtaacccggtacccgggttaacccgggaaccgggtttaaaccgggttttagttaaaccgttttaacggttttaaacccggcggggtttaaacgggtaaacccggggaccccccgttttaaaccccggaacgtttaacgggaaaaccc

SEQ ID NO: 279365 - DNA, 768 bp, Homo sapiens
  misc_feature: GYAE6OF02JW7J6.19.71.G05.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtcgtcgcaagagagaggggggagtacaacaggcaggcaggggcagcaagatggtgtgcagacccaggtcttcatttctctgttgctctggactctcgtggtcgcccacggggactatcgtgatcgaccctagtcctccagacctccgtggctgtgtctcgtgggcgaggccggccaccatcacgtcgacaacgtcgacgccaactaactttctttaanactacgttaccaactaatacgtaaaactacgttagtcgttaccggtaaccagacgacgaacgtaccgaaggacctacggtccttaccggtaggcccttacggtaccttacgtaacgtttaaccggtggaccttaacgtaccccggtaacccgggtaacggttcccgggggaccctacgggtaccgtaacgttcgacgggttcgcgtaaccggtcggggttacgtacgggtaccggtaattaccgtttaccacgtacccgttaccgacctacgtaccggtatacccggacgttaccgcgtacccggaggtacggacggtaaacgttacgtacggttacggtacctttagttttaacttacgtaccgttacaaacgtttaattaagtttaacttaactttacggttaccgggtaggttacccgtacccgggtaacggtaaccggtaacgggtaacggttgtaacgttagtaccggaacggtacggttaacgttcggtacggccgtaccggtaacg

SEQ ID NO: 279366 - DNA, 847 bp, Homo sapiens
  misc_feature: GYAE6OF02FRV1A.19.71.G05.1.454.CMB.1.raw
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccgacggggacagtcgtgatcgacccagtcctccagacctccgtggtctggtgtctcgtgggcgaggccgggccaccatcctaaactgaccaacggtcccacggaccctaactaactttaccgtttttaactaaccgtaaccggttacccaaaacgtaaagtaacgtaaaaaccttacgttacggtaccgtttacggtaaccagtacgaagaaccggaaccgacggaaccgaccggtaccccttaccgggtaacgggtcctacggtaccttacgttaacgttttaccgggtacgggtacttaaccgttaccccggtaaaccccggggttaaccgggttccccgggggttcccgtaacggtacccgtaacttccggtaggtcgggacgtacgggtccggtcggtacgggactacgttacgttaccgaccttacgtacccaacctaccacgacgtaccctacggtcccgtacgggtacgacggtacggtaacggaacgttaggttcgggtaacgttacgtttaagttttacgtttgttaacgttaactaaacgttaaattttaactttaagtttaaccttaccggtttacggtacgggttaaccggtccgggtaaaccgtaacggggtaaccggtaagggtacggtaaactaccgttaacggaacggttaaccggtacggttcgggtccggtaccgtactaaccccgg

SEQ ID NO: 279367 - DNA, 891 bp, Homo sapiens
  misc_feature: GYAE6OF02IGQ2I.19.71.G05.1.454.CMB.1.raw
  modified_base (133)..(133): a, c, t, g, unknown or other
  misc_feature (133)..(133): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctntggtgcccacggggactatcgtgatcgacccagtcctccgaagtcctcccgtggctgtcgtctcgtggggacgaggccgggaccacctactacaacgtcgacgaacggtccagacccgaataacttttctttaagtaacctacgttaccaaacgtaaagtacgttaaaaaccgtacttacgcgttacggtaaccaggacccgaagttaacgaactacggacctaccgccccgtaccgtacggctacgtacctacgtaacctttacggtacgggtaccttaaccgttaccccggtaaaacccgggttccgggttacccggggtaccccttaggggtaacccgttacggttaaccgtcggggtaacgggtcccgtaaaccgggggttccggggtttaaccggtacgggggttaaaccgtaccgttttacggttttacccctaacgtttacccgttaaccggtaaccctaaaccgtttacggaaccgtaccggtaccgggtaccgttacggtaaccggtcggtaaacggttacgtaaggtacgggttacggtaacggtttaccggttaaaggtttttacgtaaacggttaacgttaaccgtaaaccttaaggttaacctttttaagtacccgtttacggttacggttacgggttaacccgttacgggtaaccgggtaaccgggtaacggtaacgggtacggttaacgtaccgacgttaacggttaccctaagggttacgggtctaccggttacggtacccg

SEQ ID NO: 279368 - DNA, 782 bp, Homo sapiens
  misc_feature: GYAE6OF02GYBXF.19.71.G05.1.454.CMB.1.raw
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatgacccagtctccagactccctgctgtcgtctcgtgggcgagccgggccaccgatacaactgacaacgtccacgccaactaattcttttaanactacgttaccaaactaagtactaaaactaccgttagtattccggtaaccagcaaggacaaccaggaacacgccctaccgtaggcttcgacttactactttacggnggtactactaccggtacccgggtaacggtccccggggtacctacgtaccggtatacggtacggtaggctaacggggtcgggttacggtacggggaacttacggtacgttttaccgaaccttccgtaccaaccgtaataccgtacggacgtaacgccttacgggactacggtaccgttagaaacggttagtcgggtacgttactttaaggtttttaactacgtttacgtaacctaaaagttaagtttaactttaacgtttaaacgtttacgttacccgggggtttacgtttaaccggggttaccggaaacccggttaaagggggtaaccctttaaacgggggttaaccggtaaacgtttaaaccgagggttaaaacccggtttaacggtaaacgggtttcggaacgggttacgtacccgtaaacccg

SEQ ID NO: 279369 - DNA, 889 bp, Homo sapiens
  misc_feature: GYAE6OF02HJS40.19.71.G05.1.454.CMB.1.raw
  modified_base (417)..(417): a, c, t, g, unknown or other
  misc_feature (417)..(417): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccacgacctcccgtggctgtcgtctcgtgggcgaggccgggaccacgactcaacgtgacaacgtccgaacgccaactaactttcttttaactaccgtacgttaaccaaacgaaattaacggtaaaaaccttaccgttaacggtacgtttaacgggtaacccaaggtacgaacggaccgaacccgaggtaaccgaccgtaccctttccggtaaggtccttcggtccttacttaacgttttaccggngggacctaacgttaccccggtaacccggggtaaccgttcccgggggttacccctacggtaacccgtagtttccggaagggttccggaccgaacgggttcccgggttacgggtaccgggtaactacgggtttacttttaccccgaacgtttaccctacccacccggttaaacgtacccgaacggtaccgaccggtcccgtaacgtaccggacgggtaccgttaaaggtaacgtcggtagggtaacggttacgtttaacggtttttaagttaacggtttaacggtaaccttaaaacgttaacgttttaattttaaccggtttaaacgtttaccggttacgggttaccggggttttaaccgtacccggggaaccggttaaccgggggtaaccggttaaggggtaccgttaagttaaccggtacggtaaaccggtacggttaacgttacggggtaccgtcggttaccggtaacccg

SEQ ID NO: 279370 - DNA, 628 bp, Homo sapiens
  misc_feature: GYAE6OF02HBMCG.19.71.G05.1.454.CMB.1.raw
  modified_base (248)..(248): a, c, t, g, unknown or other
  misc_feature (248)..(248): n is a, c, g, or t
  modified_base (445)..(445): a, c, t, g, unknown or other
  misc_feature (445)..(445): n is a, c, g, or t
  modified_base (489)..(489): a, c, t, g, unknown or other
  misc_feature (489)..(489): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccgacgacctccctggctgtcgtctctgggcgagccggaccacatacaactgacaagtccagaccactaattctttaanactagttaccaaatactaagtaaaactacttagcttacggtaacacgacagacgaccaaggtacacgtcctacctaggctcgctactacgtttacgcgggacacgttaccgtaaccgggtacgtacccggggtcctaggtaccgtattcgaagttcggcgaggtacgggtcgagggacctaggtctttacacgttcnctaaccatccagccagctacggctagctacgagtacgtgtacgnttaacgtttataagttagaacctaagtaattagtttacttaacttacggttgtacggtacggttacggacggtaaggtaacctaaggacggttaatacgtagaacggttacgaaacgttcggtaggtaccgtagaaccg

SEQ ID NO: 279371 - DNA, 790 bp, Homo sapiens
  misc_feature: GYAE6OF02HV690.19.71.G05.1.454.CMB.1.raw
  modified_base (197)..(197): a, c, t, g, unknown or other
  misc_feature (197)..(197): n is a, c, g, or t
tcagtactctcgtgcacgaccggtgctcgatttagtgtcgtcgcaagagagaggggaggtacaacaggcaggcaggggcagcaagatggtgttgcaggacccaggtcttcattctctgttcgctctggattctcgtggtacgccccgagggacagtcggtgactcgaacccgagtcctcccgtagtaccttccccgnggtacctggttcgtcctcggtcggggccgacggtccggaccaccatcgaacgtcggaccacgtccgagtaccaactacgtttaccgtttacacgtacttaaccaacctaagtacgaaaaccttcgttacgtacgtacgtacgacgactacggaacgacgacgacctacgtccgtacctaggtccgtctccgttaactagttttaccggcggtacctaaccgttccggggtaacccgggaaccgttcccggggaccgtacggtaaccgtcttacggtacgggtcggacgtaacgggtccggtacggtaacggttaacgacggtttactacgtacgtacgtaccctacgaacgttccgtaacgcgttaccggtacgtccggacgtagtaaccgtacggtaagtcggtttcggacgtttactacgttttagttaccgttacgttaacgtaaacgtttaacgtaacgtttaaccttaaccgtttacggtcgtttaacgggtaccggtttaccgaaccgggttaacgggaacgtaccggggtattaacgaacggtacgttaaccgtacggtaccggtttacgcgtacgtcgtaacccg

SEQ ID NO: 279372 - DNA, 767 bp, Homo sapiens
  misc_feature: GYAE6OF02GVCDN.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgccgacggggacatcgtgatcgacccagtctccagacctccgtggctgtgtctcgtgggcgaggccgggccaccactacaacgtcgacctaagtccacgaccaactaacttctttaactactacgttaccaaactaatacgaaaacttacttacgtacttacggtaccagacagacgacgagacacgcctcgtaggctcgctactactttacgtggactacgtccggtaaccgggtacggtcccggggtccctacggaccgtactcgtaggtcggacgtacgggtcgggtacgtacgggacgtaggttacgtttacaccgtttcctacgaacctacgtacgaacgtccggtaccgtaccgtcggtaccggtacggtacgttaacggtaacgtcggttacggtacgttaacgtttaaggttttaactttacgtacggttaaacctaaacgtttaaacgtttacgtttttaaacttaacggttttaccgtttaacggggttaccggtttaacccggggttacggtaaacccgggtaaacgggttaaccggtaacggggttaagtaacgttaaccgtaacggtaacgggtaaccgttaacggttcgggtaccggtacgttacggtaacccg

SEQ ID NO: 279373 - DNA, 842 bp, Homo sapiens
  misc_feature: GYAE6OF02HFZ91.19.71.G05.1.454.CMB.1.raw
  modified_base (157)..(157): a, c, t, g, unknown or other
  misc_feature (157)..(157): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacgggacatcgtgntcgacccagtctcagtacctccgtggctgtcgtcctgtcgggacgaggccggaccaccagtacaacgtcgaccgtaacgtccgacgacccaacttaacttttccgttttaacaccgttaacgttaacccctaaaacgtaaagttaaacggtaaaaacctttaccgttacgggtacctttacgggaaaccccagggtaaccaacggtaaccgtaaaccgaacgggaacccgaccgtacccgttaccgtagggccttcggtaccttacttaaccgttttacggcggtaccttaaccggtaccccgggtaacccgggtaacggttccccggggttaccctacggtacgttacgttacggaggtacggtaccggtacggtccggggtttacgaacgggtaacgttacggttaaccgtttccaaccgttccttaacccgaaccttaaccggtaccgtacggtaaccctacggtacccgtagacccggagttaacggtaagaagttcggtagggtacttacgtttaagtttacttaagtttaccgtaattaacgtttaaatttacgtttaatttaccggttacggttacggttaccggtaccggttaccggtacggtaaccggttaacggtaaggttacgtaagtaccgtaacgtacggttacgtaagttccggtagtaccgtagtacccg

SEQ ID NO: 279374 - DNA, 728 bp, Homo sapiens
  misc_feature: GYAE6OF02ILZF2.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgttctggatctctggtcgcccgacgggggacagtcgtgatcgacccagtcctccagtacctccctggctgtgtctcgtgggcgaggccgggccaccatccgaatcgacaacgtccacgaccactaattcttttactaactacgttaccaaactaataacgaaaaaccttcttaacgtctttacggaccagacagaacgaccaaggacacgcctacgtaggctcgcttactacgtttacgcgggactacgttaccggtaacccggggtaacgttcccggggtacctacggtaccgtagtttacgaggtcggtcgaacgggtcgggttacggtagggtactaggttactttccgacttccgtacacccgtaagtaccgacgcctacggtccacggacggtacggtaacgtacgggtaaacgttaggttccgggtaggttaacctttaaggtttactttaggttactaaccttaaacgttaatttagttttaacgttaaacctttcggttacggttcgggttaaccgttaccggacgtaaacggtaccggtaggtacgtcttaaccggataacgtacggttacgtggggacctcggtacgaccttaccg

SEQ ID NO: 279375 - DNA, 824 bp, Homo sapiens
  misc_feature: GYAE6OF02JRAKP.19.71.G05.1.454.CMB.1.raw
  modified_base (551)..(551): a, c, t, g, unknown or other
  misc_feature (551)..(551): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttcgctcgtggatctctggtcggcccgtacggggacacgtcggttgaacgtcggaaccctacgtctcccgaacggtaccctcccgtcggccgtggttcgttccgtcggtcggggcggacgggcccggggacccaaccgacctacgaaaccgttcggaaccgaacgttacccgacgtaccaacgttaacctttacttttaactacctacgttaccaaaactaagttaaccgaaaaccttacgtacgtacttacggtaccacgtcaacggaccgtacgaacggacaccgtcctacggtacggctcggtccttagtacgtttacgcgggtacaacgttacccggtaaccgggtaccggttcccggtcctacggtaaccgttcgtacgtggcggtccggtacggtcggtcggtacggtaacgtactacgtttacnccgtaccgccgtaacacgttcgacgtcgtaccggctacggagtaccggtacgtaagtacgtacgttcggtaagttacgttaacgttttaacgttacgttaacggtaaactaaccgttaagtttaacgtttaactttaccggtaacggttaccgggtagggttaacccgggtacgtaaacccgggcgggttaaaccgtaacggggttgtaaacccgttacgtaaccgtaacgggtaacccgttaggtacggtttaccgtacgtacccgtaacgg

SEQ ID NO: 279376 - DNA, 640 bp, Homo sapiens
  misc_feature: GYAE6OF02I2TIY.19.71.G05.1.454.CMB.1.raw
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (324)..(324): a, c, t, g, unknown or other
  misc_feature (324)..(324): n is a, c, g, or t
  modified_base (411)..(411): a, c, t, g, unknown or other
  misc_feature (411)..(411): n is a, c, g, or t
  modified_base (574)..(574): a, c, t, g, unknown or other
  misc_feature (574)..(574): n is a, c, g, or t
  modified_base (582)..(582): a, c, t, g, unknown or other
  misc_feature (582)..(582): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
tcagtactctcgtgcacgaccggtgctcgatttagtgtcgtcgcaagagagaggtctagagtggctgggaaggacatatttcatgtccaacatgtggaatacaaattatgcaccatctgttgagagtcgactgaacaatcaacgtagacacatcgaagaaccagttctcccngcagctgacctntgtcgacctcccgaggacgacgggtgtattattacgtggtaggaagccggccccatagactatcgccctaccctcgtctcgttggtgctagttacgttcggggcccgaagggaaccctagtcgtccacccgttccgtccnccggtccctaccgaaccgtaacgggcccaacgtttccggtccccttccccgtaggccccgtccctcgtccgtccgaagggccgaccncccgtaccggagtcgcgacgacggtccccggacgtcgggcctcggccgttacgggacaaacgggtacctttaccccgtaccccaaggtaaccgtaacgttacccgtagggacggtacccggggtacgttcgggaaccgtaccgggaccgttataacggtcgtncgtacgcngagacgcncngngagtacgcncgntcgcgtgtagtagtagactacgtcgtcgtgcgcg

SEQ ID NO: 279377 - DNA, 723 bp, Homo sapiens
  misc_feature: GYAE6OF02J05JT.19.71.G05.1.454.CMB.1.raw
  modified_base (252)..(252): a, c, t, g, unknown or other
  misc_feature (252)..(252): n is a, c, g, or t
  modified_base (642)..(642): a, c, t, g, unknown or other
  misc_feature (642)..(642): n is a, c, g, or t
tcagtactctcgtgcacgaccggtgctcgatttagtgtcgtcgcaagagagaggggggaggtacaacgaggcaggcagggcagcaagatggtgttgcagacccaggtcttcatttctctgttgctctggatctctggtcgcccgacgggacatcgtcgagtcgaccctagtcctccgagacctccctggcctgtgtctcgtggcgacgcggcccacgatccaatgacaagtccacgccactaattcgtttanacgacgttaccaaataacgtagaaaacttcgtacgtcgttagtacccgagcgaagacgaccacgacgtacgtaccgtaccgtagcgttagcttacctacgttttacggacggtacctaacgttacccggtaacccggggtaaacggttcccggggtacccgttaccgggtaacctacgttccgtaagggtcggaccgtaaggtcccggggttatacggggactaaggtacttttacccgacgttccgtaccgaactcgtacgacgtacgacgtccgttacgagtacggactagtaacgtacgtcgtaggtaccttaagggttttacttccgtagtaacccgtaataacgtttattaacttagttaccgttacggtacgttacccgggtanaacccggtaagggaccgtaaggttacgaacttaacgtacgtaacgttaccccggagttacggtacgtacgttcccgaaccg

SEQ ID NO: 279378 - DNA, 556 bp, Homo sapiens
  misc_feature: GYAE6OF02HGAV2.19.71.G05.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaacaatagaaaactacttagcttggtaccagcagagaccaggacagcctcctaggctgctcatttacngggcatctacccgggatcccggggtcctgaccgattcagtggcaggcgggtctgggacagtactttcactctcaccatcagcacgccctgccgaggctagaagtgttgtcgtcttagtttattagttgtactaactaattattactttaacttacgttacgtacggtacgttccggaacgtaacggggtacctaagggtggtaatacgtacgaacgtacggtaactggtcggctggaccc

SEQ ID NO: 279379 - DNA, 742 bp, Homo sapiens
  misc_feature: GYAE6OF02HLJ4K.19.71.G05.1.454.CMB.1.raw
  modified_base (393)..(393): a, c, t, g, unknown or other
  misc_feature (393)..(393): n is a, c, g, or t
tcagtactctcgtgcacgaccggtgctcgatttagtgtcgtcgcaagagagaggggggaggtacaacaggcaggcagggcagcaagatggtgttgcagacccaggtcttcatttctctgttgctcgtaggatctcgtggtcgcccgacggggacattcggtgactcgacccagtctaccagacctccgtgctgtcgtctcgtcggcgacggccggaccacagtaccaacttcgaccgtaacgtccaacgaccaactaacttcttttaacacgtacgttaaccaaactaacgttaacgaaaaccttacgttagtcgtacggtaaccacgtacgaacgtacgaacctagtacgaccgtacgtcccgtacgtaggctcgtcctacgttagttacgngtacgacttaccggaccggtagtccggtcccgacgtaccgtagttcgaggtacggcgtaggccggttagcggtacaagtttctttacgacttcgtaccaacgtactacgacgacgtacgtcgtacggacgaccggtacgtaagtaacgtacggtacgtcggttaacgttaagtttaacgtttacttaacggtaactaacgtttaaactttattttaacttacggtaccgttttacggtaccggttaccgttaccggtaaccggtaaacggtaacccgttaagggtaccgttaacgtaccgttacggaacgtaaaccggtaccggttacggttacggtaccttaacccgg

SEQ ID NO: 279380 - DNA, 756 bp, Homo sapiens
  misc_feature: GYAE6OF02GDD1H.19.71.G05.1.454.CMB.1.raw
  modified_base (88)..(88): a, c, t, g, unknown or other
  misc_feature (88)..(88): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagtactctcgtgcacgaccggtgctcgatttagtgtcgtcgcaagagagaggggggaggtacaacaggcaggcaggggcagcaagntggtgttgcagacccaggtcttcatttctctgttgctctggatctcgtggtcgcccgacggggacagttcggtagagttcgaaccccgtagttcctccgagtacccttcccgtaggcttggtcgtcctcggtcggggacgacgggccgggtacccgaacctaacgtaccgaacgtcgaccgaacgtcccgagtccaaactactttactttaaacgtacgtaaccgttaccaaactaacttaaggtaaaaacctttacgttaacggtacctttacggaacccgagaccgtaacgggaaacgtaccggtaacggacctaccgggtacccttaccgtacggccttcgtcgtaccgttagttttaccgaggtccaacgttacccgaaccgggtaccgtcccgggtacctgacgtactcggtcggnggtacgnggtccggtagtaccggagtactacgttcactccgtacacgacttacgactcgaccgtctacggacgtacgtcgtaaggaacgtagttcggtacgtactttaacgtttagttacgtacgtaactaaagtttaccgttaagtttaacgttcgtaacgttcggtacgtacggtacgacggtaacgaggtacggtagtaactagtaccgtagtaaccggtacgtacggtactacggtacaccgg

SEQ ID NO: 279381 - DNA, 697 bp, Homo sapiens
  misc_feature: GYAE6OF02JRO57.19.71.G05.1.454.CMB.1.raw
  modified_base (109)..(109): a, c, t, g, unknown or other
  misc_feature (109)..(109): n is a, c, g, or t
  modified_base (121)..(121): a, c, t, g, unknown or other
  misc_feature (121)..(121): n is a, c, g, or t
  modified_base (127)..(127): a, c, t, g, unknown or other
  misc_feature (127)..(127): n is a, c, g, or t
  modified_base (163)..(163): a, c, t, g, unknown or other
  misc_feature (163)..(163): n is a, c, g, or t
  modified_base (184)..(184): a, c, t, g, unknown or other
  misc_feature (184)..(184): n is a, c, g, or t
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
  modified_base (398)..(398): a, c, t, g, unknown or other
  misc_feature (398)..(398): n is a, c, g, or t
  modified_base (692)..(692): a, c, t, g, unknown or other
  misc_feature (692)..(692): n is a, c, g, or t
tcagtactctcgtgcacgaccggtgctcgatttagtgtcgtcgcaagagagaggggtcaggctggaactgaggagcaggcgaggggcagcaagatggtgtgcagacccngtcttcatttcntgttcncctgtctctcgtcggtgccccgaggacgactcggtnatacgaccaccgttcaccacncctccgttcctgtgtccacgtgggccgaagcgggtcccaaccgtcnccgaacctgacagtcccagtcccataagtctttaacacacgttacaactacgtanaacgtactaagtctagtacacgacatacgacacggacagcctacctggggtacctgtccgtcgtactacgttggacggacttcccggtaaacgtaccggtaccgtccggtacncgtacgttacgcgtaggtcgtaacggcgtacggtacgacggactacgttacctaccgtcctaacccgtctacatcgagtaacccgtgtacccgtaacggtaccggtacgttacgacgtagggttaccgttaaggttcgtttaactttacgtttaactttacgttaaccttaaagtttaaccttaagtttaagtaacgtttaagttcccggtttacgtaccggttaaccgggtaacccggtacccggaaaggttcgggtaagtacgtaccgtagttaacccaggtacgtaccggnttacg

SEQ ID NO: 279382 - DNA, 654 bp, Homo sapiens
  misc_feature: GYAE6OF02FYKH7.19.71.G05.1.454.CMB.1.raw
  modified_base (127)..(127): a, c, t, g, unknown or other
  misc_feature (127)..(127): n is a, c, g, or t
  modified_base (133)..(133): a, c, t, g, unknown or other
  misc_feature (133)..(133): n is a, c, g, or t
  modified_base (648)..(648): a, c, t, g, unknown or other
  misc_feature (648)..(648): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttnatttcnctgttgctctggatctctggtcgcccgacggggacagtcgtgatcgaccagtcgtccagacctccctggcctggtcgtctcgtggggcgaggccggtacccacaacgtactaacgtcgaacgtaacgtccgagacctaactaacttccttttacactacgttaccaacaagtaacgtaaacctaattacggaccgtttacggtaaccaacgtcgaacgtaacgaccgtaaacggaccaacggtccctaccgtacggtcctggtacttacgtacgtttacgtcggtactaacgtaccggtaccgacggttcccgggtacctaggacgtacctcacggtggccgtaggcgtacgtacggactaggtacttacgactccgtacgaacgtatacgcgtacgtacgcgtacgcgtagcgtaggagactcggagtagttatttactagtactaacgaatacttagttacaagtttcgtacggtaacgttcgaacgcgtacggtacgtaggtacgactacgntaacgg

SEQ ID NO: 279383 - DNA, 969 bp, Homo sapiens
  misc_feature: GYAE6OF02GAT0Z.19.71.G05.1.454.CMB.1.raw
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtcgcccgacggggacatcgtgatcgacccagtctccagacctccctggctgtcgtctcgtgggcgaggccgggccaccatacaacgtcgacaacgtccacgcccaactaactttaccgttttaataaccgtacgttaacccaaaacgtaaacttaacggtaaaaaccttacgttaagtaccggtttaacggtaacccaacggaccgaacggaacgaaccccgtaagggtaaccgtaccggtaccccgttaccggtacgggtcctttaccggacctttaccgttaacgttttaccgggtacggggtacctaaccggttaccccgggtaaaccccggggtaaccgggtttcccccggggggttacccctaccggggttaacccgttagtttacccggtaacgggtttaccgggaccggtaacggggttcccgggggggttaccgttacggggggtaaacccgttaaggttttacccgttttaccccgttaaacgttttcccccgttaacccgtaaaccccggtactttaaccggaaaccggttaccgaaacccggtttcccggaaccggggtacccgaaccgggttccgggttaaaggtaacggttccggttacggggttaacgggttaccttttaagggttttaaacgtttacgttaaacgttacttaaaccggtttaatttaacgttttactttaaacggtttccggttaagggttaccgggtaccggttaccgggtaaccggtaaccggggtaacggtaagggttaacgtaagttacccgaccggtaaacggtaccgttaacggtacggttcggtacctacggtaacccg

SEQ ID NO: 279384 - DNA, 695 bp, Homo sapiens
  misc_feature: GYAE6OF02H6QDW.19.71.G05.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (361)..(361): a, c, t, g, unknown or other
  misc_feature (361)..(361): n is a, c, g, or t
  modified_base (483)..(483): a, c, t, g, unknown or other
  misc_feature (483)..(483): n is a, c, g, or t
tcagtactctcgtgcacgaccggtgctcgatttagtgtcgtcgcaagagagagggggtcaggctggaactgaggagcaggcaggggcagcaagatggtgtgcagacccaggtcttcatttctctgttgctctggatctcgtggtcgaccccgacggggacagtcgtgatcgaccctagtcctccagtcctcccgtggctgtntcgtcggtcgggcgacggccggaccaccatacaactgacacgtccacgctaactattacttanactactaccaaanaataacaaactatacgtcttaggaccagaccaagaccgacgaacgactaccgcctaccgtaggacctgtactactacgttcgnggactacgtaccggaacccggtacgtcccgggtcctacgtaacgttacgtacgcggtacggtcgacggggtccgggtacgtacgggtacgaggttacttaccgtactacgtaccgtaaaccncttacgacggacctacgtacccgacggtacgtacggtagtacgtaaagtcgtgtacgggtacgtttaaggttacttacgtttaccgaaacttaaacttaattaattacgttaacgttaaccggtcggttaacggtaaccgttaaccgggaccgtaaacgggtaacccggtaaggtacggtacttaacgtacggaacgtacggtacggttacg

SEQ ID NO: 279385 - DNA, 775 bp, Homo sapiens
  misc_feature: GYAE6OF02GN7N0.19.71.G05.1.454.CMB.1.raw
  modified_base (178)..(178): a, c, t, g, unknown or other
  misc_feature (178)..(178): n is a, c, g, or t
tcagtactctcgtgcacgaccggtgctcgatttagtgtcgtcgcaagagagaggggggagagtctgctgaattctggctgaccagggcagtcaccagagcctccagacaatgtctgtctccttcctcttcttcctcgccgtgctcgggcctcccagaaggtcgtcctgtcacaagtangcgtgcagcgtatcgtacggtccgaaggtacgtgggtacgaaccgtcccgtcgccaccgtaccccttcgtccgtacctccgtaccgtcggtcgacctacggtacccggtccgggaacgtagcggttcgacgtaacggccgtaacggtgttgtttcgtaccggttgccgttacggttcgggacgacggtaccgtacccgccgttaaggccggtaggtacggttacggtagtggggttaccggacggtaaacgggaaaccggtactagtttaaccttacggaacgtttccgaaaccgaaacgttccggtaaaggtaaacttaaacgtaagtttacgccgaactacgtagttccgtagtaggtacgtacgtacgtacagaacctaacgtactaacggacaaacgtacgtaaacgtaacggtaaaccgtagttacccggttactcccggtagtaccctacggtccttaaccggttaccccttaggtaccggttacctacccgggtaccggtaaccgggtaaccgttagggttaccgttaacttaacgggttacccgagggtacccggaacggtacccggtacccgtaacgtagtaacccgg

SEQ ID NO: 279386 - DNA, 753 bp, Homo sapiens
  misc_feature: GYAE6OF02FNH5I.19.71.G05.1.454.CMB.1.raw
  modified_base (158)..(158): a, c, t, g, unknown or other
  misc_feature (158)..(158): n is a, c, g, or t
  modified_base (368)..(368): a, c, t, g, unknown or other
  misc_feature (368)..(368): n is a, c, g, or t
  modified_base (473)..(473): a, c, t, g, unknown or other
  misc_feature (473)..(473): n is a, c, g, or t
  modified_base (746)..(746): a, c, t, g, unknown or other
  misc_feature (746)..(746): n is a, c, g, or t
  modified_base (751)..(751): a, c, t, g, unknown or other
  misc_feature (751)..(751): n is a, c, g, or t
tcagtactctcgtgcacgaccggtgctcgatttagtgtcgtcgcaagagagaggggggagtacaacaggcaggcaggggcagcaagataggtgttgcagacccaggtcttcatttctctgttgctactggatacttctggtcgccccgacggggaacngtcgtgaagtcgacccgtagtctccgagtacctcccgtggccttgtcgttcgtacgtcggggcggacggccggggaccacccgaagtaccaaccgtggaccgtaccgttacgcacctacgaaattccttttaagaccttagtaaccaacaaataacggaaaaccttcgtaacgtctacggtaacacgcgtaacggacaccgaacggaacnccggtccgttaacggcgcctggtccttaccgtagttttacgacggtcttaagtccccgtaccgggttaccggttcccgggtcctcggtaacgtagttaaccgggnggtcgtaggtaccggcgttacggtacggacgttagtaccgttcgtaacctccgtaccgtaccgacggaacgtacgtaccgtaccgtcgtacgccggtagtacgtacggtaacggtagtacggtcgttacgttagtttacgttacgttaagtaacgttaacgttaaacgttagttaaacgttacgttacgttaacgggttacggtacggttacgggtcgttaacggtcggtaaccggtaacgtcgttacgaagtagtacggtaccggtagtcgngtacncg

SEQ ID NO: 279387 - DNA, 725 bp, Homo sapiens
  misc_feature: GYAE6OF02G1VG5.19.71.G05.1.454.CMB.1.raw
  modified_base (107)..(107): a, c, t, g, unknown or other
  misc_feature (107)..(107): n is a, c, g, or t
  modified_base (170)..(170): a, c, t, g, unknown or other
  misc_feature (170)..(170): n is a, c, g, or t
  modified_base (290)..(290): a, c, t, g, unknown or other
  misc_feature (290)..(290): n is a, c, g, or t
  modified_base (417)..(417): a, c, t, g, unknown or other
  misc_feature (417)..(417): n is a, c, g, or t
tcagtactctcgtgcacgaccggtgctcgatttagtgtcgtcgcaagagagagggggtcaggctggaactgaggagtacaacaggcaggcagggcagcaagatggtnttgcagccaggtctcatttctctgtgctctgatctcgtggtcgcccgaggggactatcggtanacgtagaccctagtcctaccagacctcccgtggcttgtccgtccttgacgggtcgacggccgggacctaccgaatccaacgtacggcctaacgccaaggccccaattaaacttcttttanaccgaagtttaccaactaaatacgtaaaacttcttaagcctttaggaaccagtacaacggtaaccgacgtaaacgggactaccggtaccttaccgtacggtctacggtacctacgttagtttaccgnggtacaaccgttccggtaaaccggtacgtcccgggtacctaggaacctagttcgacggtggcccgtaggtaccgggtcgtacggacgtaaacgttcgtaccttccgtaacctccgtaaacctcgtaaccgtaacgccgtaacctccgtacgaacgcgtaccgtaagaacgttgtaacgggtcgtaagttacgtttaacgtattaacgtaactaacgtaatttacgttattaaccgtacgttaccgttaggtccttaaccgggaataccgggttaacgtacggttaagtaaccgttagtaacgtaaccg

SEQ ID NO: 279388 - DNA, 736 bp, Homo sapiens
  misc_feature: GYAE6OF02JZDCU.19.71.G05.1.454.CMB.1.raw
  modified_base (180)..(180): a, c, t, g, unknown or other
  misc_feature (180)..(180): n is a, c, g, or t
  modified_base (243)..(243): a, c, t, g, unknown or other
  misc_feature (243)..(243): n is a, c, g, or t
  modified_base (372)..(372): a, c, t, g, unknown or other
  misc_feature (372)..(372): n is a, c, g, or t
  modified_base (557)..(557): a, c, t, g, unknown or other
  misc_feature (557)..(557): n is a, c, g, or t
  modified_base (676)..(676): a, c, t, g, unknown or other
  misc_feature (676)..(676): n is a, c, g, or t
tcagtactctcgtgcacgaccggtgctcgatttagtgtcgtcgcaagagagaggggggaggtacaacaggcaggcaggggcagcaaagatggtgttgcagacccaggtcttcatttctctgttgctctggatctctggtgcccgacggggacatcgtgatcgaccagtctccagactccnggctgtgtctactgggcgaggccggccacgatcaactgacaagtcagcctaacaattctttanaccgtacgttaaccaacgtaaatacgaaaaccttacgttagaccgttttaggaacccgagaccaaggtaacgacccgaaggacctacgtcccttaccgaaggtcttaggccctacgtaacttttacggnggacctaacgttacccggtacccggggaacgttccccgggggtccctaggaacccgttagttaccggtaaggtcggaccgtagggtaccgggttacggtacggggaaccgttaagtacgttttacccaacgttacctaccgaacctagtacggaacgccgtacggacccgttgaaccgtacggtntaacggaagtacggttggacgtacgtttaagggtttacctagttacggaacttaaagaacgtttattaaacgtttacttacggttagtacggttaccggtacgtaccggtaaacggggngtaacggtttagaagtaaccgtaggacgttaaccggtggtacgtacggtcgtagtacccg

SEQ ID NO: 279389 - DNA, 815 bp, Homo sapiens
  misc_feature: GYAE6OF02F08QN.19.71.G05.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (354)..(354): a, c, t, g, unknown or other
  misc_feature (354)..(354): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacattcgtgaatcgacccagtctaccagacctcctggcttgtntctcgtggcgagcggaccactancaactcgcaatccacgaccacgtaattctttanacagttaccaaatagtaacgaaacttactagtacgttacggtaaccacgactaagacaccgaaggtaaccacgcctacgtacggtctcgacttactacgtttacgnggcctaagtacccgtaaccgggtacgtcccggggttacctacggtacgttaccgtacgtaaggttccggaacggtacgggtcgggttacctacgggggtaacctaacgggttttaacccttacggaacctttcccgtaaaccgtaaccgttaccgtaacgtaaacgtccggtaacgtaccccgttaggtaccgaagggtaccgtaaggtaaccgtaaggtttaccggaagtttaaccgtttaacgttttaacgtttaaacgttacggttaaaccgtaaacttaacttttaaacttttaacggttaaacctttaccggttagggttaacccgggttacgggttacccggttaacccgggtaaacggtaacccgggttaaaggtacggttaaccgttaaacccggtacgttaacggtaccggtaacgttaccgggttaacggttaccggtacccgtaaacccg

SEQ ID NO: 279390 - DNA, 796 bp, Homo sapiens
  misc_feature: GYAE6OF02JWFNH.19.71.G05.1.454.CMB.1.raw
  modified_base (103)..(103): a, c, t, g, unknown or other
  misc_feature (103)..(103): n is a, c, g, or t
  modified_base (115)..(115): a, c, t, g, unknown or other
  misc_feature (115)..(115): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (540)..(540): a, c, t, g, unknown or other
  misc_feature (540)..(540): n is a, c, g, or t
  modified_base (638)..(638): a, c, t, g, unknown or other
  misc_feature (638)..(638): n is a, c, g, or t
  modified_base (699)..(699): a, c, t, g, unknown or other
  misc_feature (699)..(699): n is a, c, g, or t
  modified_base (787)..(787): a, c, t, g, unknown or other
  misc_feature (787)..(787): n is a, c, g, or t
tcagtactctcgtgcacgaccggtgctcgatttagtgtcgtcgcaagagagaggggggaggtacaacaggcaggcagggcagcaagatggtgttgcagacccnggtcttcatttntctgttcgctactggactcgtcgtggtcgcccgagggacctgtcgtgactccgacctaggtcctaccgacgaccgtcccgtggcttacggttcgtccgtcggtacgggccgaggccggacctacctagtccacgtgtacctaacgccgaagtaccctaatacgttttactttacgaaaccncgtttaacccgaaanaaaccgttacggttaaaacccgttgttaccggtacggttaaccggaactaaccggtactaacgggaccggttaacacgggtccgtaaccgtcccggtaaaacctcggttcgtccggtaaactttaccaggttttaaacgcggtacccttaacgtaccccggggttaaaaccggaccgggttccccggtaccgtttgaaacccgttcgtgtaaccgggcgagtacccggnggttaccgagtaacccggtgttctacccgtacctaccacgttaccggattacgccggaagccgtcgtaccgtacggtacgttacggaataccgggtanccggttacttaacggtttactttacggttattacccgagtaaaccttacggtttagtttanaccgtttcggtcggtacgtacgtcgtacggtaaccggaacgttgccggtaattacggactacgggttataccgggtagtaccggttancccggtaac

SEQ ID NO: 279391 - DNA, 684 bp, Homo sapiens
  misc_feature: GYAE6OF02FVJSK.19.71.G05.1.454.CMB.1.raw
  modified_base (126)..(126): a, c, t, g, unknown or other
  misc_feature (126)..(126): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (506)..(506): a, c, t, g, unknown or other
  misc_feature (506)..(506): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctntggatctctggtcgcccacggggacatcgtgatgacccagtcctccagactccctggctgtgtctcgtgggcgagccgggccaccatacaactgcaagtccagccactaagttcttttaanacagttacccaaanaatacgaaaacttnttacgcttacggtaccagcgagacgtaaccaggaccaacggtccctccgttaagggccgtgtaccttccgtaagttttacgtagggacctagttaccccggtaaccccggggaagtttccccccgggggtaccttaccggaccgttacgtttcgaacggggttgaccgaggtccggggtctagggacctagtacttttcgactcctacacctatcagcaacgtcctagacngcgtaaggaagtcggtaggttgactttaagttttagttaccttagtaactaaacgtaattttaacgttacttacttacgttgggttaaccggttacggttacgaacggtaacggggtaactaagggttacgaattacgtaggtaacggtaccttaagtcgggtcgtacctcgtaaccc

SEQ ID NO: 279392 - DNA, 887 bp, Homo sapiens
  misc_feature: GYAE6OF02G82OO.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacgggacagtcgtgatcgacccagtctccagacctccctggctgtgtctcgtgggcgacggcggccaccgatccaactgacaacgtccacgaccactaacttcgttttaacacgtacgttaccaaacgtaactaagtaaaaccttacgttaacgtccgtttacggaaccagtacaacggaacgacccgaaggaacccacgtaccctaccgtaggtcctcggtccttacgtaacttttaccggcgggtaccacgttacccggtaacccggggtaaccggttccccggggtaccctcgggtaaccgttacgttaccgaacgggttcggacggtacgggtccggggtacgtcggggaacgtaggttacctttaccgaccttaccaccgtaaccgtacgttaccgacgtacccgtacggtcccgttacggtacccggtaacgggttaccgtaaacgggtaaggtaacgttcggggtaccggtttaaccgtttaacggttttttacgttaaccggtttaaccgttaacgttaaaacccggtttaagttttaacgttttaaacgtttaacgttttacccgggtttaacggggtttaccgggttaacccgggttaaccggggtaacccgggttaaaccggggtaaacggttaaaccggggtacggttaaccgtttaaccgggttaaccgtaaccggggttaaacggtaaccggttacgggttacccggtaccgttaacccggtaccccg

SEQ ID NO: 279393 - DNA, 866 bp, Homo sapiens
  misc_feature: GYAE6OF02JTIJ2.19.71.G05.1.454.CMB.1.raw
  modified_base (141)..(141): a, c, t, g, unknown or other
  misc_feature (141)..(141): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctgggtcncccgacggggacatcgtgatcgacccagtcctccaggacctcccgtggtctagtcgtctcgtgggcggtacgccgggacctacctactaccgaaccgtcggacctaacggttaccgacgtacccaactaactttcgttttaacacctacgttacccaaacgtaacgtacgtaaaaaccttacgttacggcctttaccgggacctaagtaccgaacgtacggtaaccaacggtaacgcccgttaccctcccgggttaagccgttacgtccgtacgtttaacgtttacggacggggtaccctaacggttccccggtaacccgggtaaccgttccccgggggtaccacggtaaacccgttgttaccgtacgggtacgtacccgggtagtacccgggggttacttaacgggggaaccttacgttacctttaccccgggaccgttccgtaacccgtaccgtaacgtacgtaaccggtaccgtaccgtaccgttaacgggacgtaccggttaccgtaaggttaacctaagggttcggttaacggttcgttaaggtttaacgttaccgttacggttaaccttaaacgtaacgtttaacgttactttaacgttaccggttaagggttacccgttaaccggtcggtaaaccggtaacgggttaaccggtcggtaaacgttaccgtacgttaaggaccgtacggtacgttagggtaccggttccacgggttaacc

SEQ ID NO: 279394 - DNA, 798 bp, Homo sapiens
  misc_feature: GYAE6OF02IMS40.19.71.G05.1.454.CMB.1.raw
  modified_base (677)..(677): a, c, t, g, unknown or other
  misc_feature (677)..(677): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacgggactatcgtgatcgaccagtcctccacgtaccttcccgtgctgtcgtctcggtgggacgacggccggccaaccacgtcaacgtcgacaacggtccaacgccctaaacgttacttttaccttttaacgtaccgtaacttacccaaaactaacgttaaacgtaaaaccttacgttaaagtccgtttaacggaacccaggacgtaacgacggaaccgaggacgacgtcctacgtaggtctacggtacctacttaacgtttacgacggtacgtaccttaaccggggtaacccgggtaaccgttcccgggggtacccttaggtaacccggttattaacgggtaacggtcggacgtaccggttcggggttacgaacggggtaactacggttaactttccgtaccttaccgtaccctaaacgtcgttaccaacggttaccgaaccgggttccgttacggacgtaacgggtacgttacggaattacggttcggtacgttacgtttattttaaacgtgttaacgtacctaaaagttntttaactacgtttacttacggttcggacgggtttaccgtaggaaccggtaacgggtaacgtacggttaacaggtttaaccgacggttaacggacgtggttcggtactaccggtacgtaacc

SEQ ID NO: 279395 - DNA, 696 bp, Homo sapiens
  misc_feature: GYAE6OF02HD44T.19.71.G05.1.454.CMB.1.raw
  modified_base (408)..(408): a, c, t, g, unknown or other
  misc_feature (408)..(408): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggactctcgtggtcgcccgagggacagtcgtgactcgaccagtctccgagtacctccgtgctgtgtcgtcgtgggcgacgccggaccacgacgtcaacgtcgacgaacgtccacgaccaacttaacgttcttttacgacgtacgttaccaataactaacgtaaaaccttcgtacgtcgttacgtaaccagtacaaggactaccgagacaccgtcctacgtacgctcgactacgtagttacgcgactacggttccgaaccggcgttcccggtactacgacgtnttacgagtacggcgtagggcgtacggtacgactacggttcttcgtactacctactacgacaccgtacgctaacgtccgtacgacggtaacgtcgtaagacggtaggtgaccgtttattaacgtttatacggttactaacgtaagttagtttaacttaagtttacctaacggttacgtacgggtttaccgtaaccgggaacggttaaccggaacggtttaacgtacgttaaacgtacgtaacggtaaccgttacggtaccgttaacggtttcacccgttaacgacccgg

SEQ ID NO: 279396 - DNA, 550 bp, Homo sapiens
  misc_feature: GYAE6OF01D6XH4.41.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
tcagtctatactatcacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggngaggcccctaaggtcctcgtctctcgtgaaaccagactggaagtagagtcccgtccaggttcagtgccagtccaggtggtgggccggagtccactctcacattagcgacctgcggcctgaagtattctgctaacttatttctgtcagcagtatcatagtcgcccgttctacgttttcggccgacggggtaccaacggtcctaaggaaactaccaaaacgtaacgttggtcggctcggacaccattcctgttcttcacttcccttcccgccattcg

SEQ ID NO: 279397 - DNA, 652 bp, Homo sapiens
  misc_feature: GYAE6OF01AVCID.41.59.F04.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (642)..(642): a, c, t, g, unknown or other
  misc_feature (642)..(642): n is a, c, g, or t
tcagtctatactatcacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcacatcacttgccggcgagtcaggttcgttttcggngcttgttcgccttaggtttacaaacggaaaagggggnacggtcccctaaggtcctacgtctcgtcgtagaaccngactaggaagtagacgtcccgtcaggttcagtcgacctagtccgaggtggtcgggccgatccactctcaacctagttacgccgtaccgtggccggacctagaacgtacttcgtacgtactaactttactttccgtacgttcacgtacgtagttactacgtagttacgtccgtaccccgtttacgttacgttttacgggacccgtaacggggtaccctaaggtccgttaacggtaactaccggaaacggtaccgttaggtacggcgtacgaccctaaccgtacgttccgttgttacccgttactacccgttcccgttacccccggnttccgttacg

SEQ ID NO: 279398 - DNA, 735 bp, Homo sapiens
  misc_feature: GYAE6OF02JFLFC.41.59.F04.1.454.CMB.1.raw
  modified_base (172)..(172): a, c, t, g, unknown or other
  misc_feature (172)..(172): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
tcagtctatactatcacgaccggtgctcgatttagtacacacacttagggattgggggcatgagtcagaccctgtcaggggacagcatggacatgagggtccccgctcagcctccgtggggctcctgctgctctggctcccaggttcgagatgtgacatcgagatgaacccngtcctccttccttctgtcttcttctgttggagcagcgtcaccntcgacttgccggcagtcgaggttcgtttggncttgtcgctggttacaaagaaaaggggnacggacctaaggtcctctcgtctacgtacgaaacctacggagtaggaacggtagtaccgtcccgtacctaggttcacggtcgcgtacgtccgagggtcgggtacgggccggtaacgtcccgtaactcgtaccgaaaccgttacgtacggccgtaacccttgggtacccgaccgttaaggtaaacgttacgtttaccgtacggtacccttaaaacttttccgtttacgtcgtaaccgtacgtcttaacggttactaacctaagttaccggccgtaaccccgttttcgtaaccggttttaccgggaccggtaaacggggtaaccccaaaggttacggtaaaccggaaactttaaaccgaaaaaccggttcgtaggtttcgaacccggtttacggacccaacgttccgttaaccgttcgtaacccgtttacctaaccgttccccgttaccccgcttaacgttcg

SEQ ID NO: 279399 - DNA, 696 bp, Homo sapiens
  misc_feature: GYAE6OF02G7ATW.41.59.F04.1.454.CMB.1.raw
  modified_base (292)..(292): a, c, t, g, unknown or other
  misc_feature (292)..(292): n is a, c, g, or t
  modified_base (641)..(641): a, c, t, g, unknown or other
  misc_feature (641)..(641): n is a, c, g, or t
tcagtctatactatcacgaccggtgctcgatttagtacacacacttagggattgggggcatgagtcagaccctgtcagggacagcatggacatgagggtccccgctcagcctcctggggctcctgctgctctggctcccaggttcgagatgtgacatcgagatgacccagtctccttccttcctgtcttcttcgtgttggagcagctcacatcacgttcgccgggcgagtcgtaggttcgttttcggagtcttggttcgccgttaggtttaccaaaaacggtaaaagggggnaccggtacccccgtaaggttccctcgtcctacgtccggtaacgaaaaccgtggtaaccgtagggtaaacgggtacgtaccgtccccggtacgtacggtttccaggttcgaccctaggtccgagggtcgggtccgggaccgtacgtccacgtctaccgacttacgtacggaccgtaccgtcggacggtcctaggaacgttcgttcgtacgtacgttaactttcttcgtaggtccagtacgtagttactcgagttaccgtacgtcccgtttactacgtttcggacgtaacgggaccaggtaccgttaagaaactacgaaaccgtcgttacggcgtacgtagacgtaccgtnttcccggttcttacccgtttacgtccgttcccgttacccgtaccttattacccgg

SEQ ID NO: 279400 - DNA, 202 bp, Homo sapiens
  misc_feature: GYAE6OF01E1L1W.43.28.C06.1.454.CMB.1.raw
  modified_base (197)..(202): a, c, t, g, unknown or other
  misc_feature (197)..(202): n is a, c, g, or t
tcagtgtgagtagtcacgaccggtgctcgatttagagctcacgtattgggtttgggtggtctccactcccgcctcagttggaagcagccgatccagcctgcggagcctgtggggcaggtcagcccaaggccaacccactgtcactctgttcccacctcctcactactcacactgagcgggctggcaaggcgcatagnnnnnn

SEQ ID NO: 279401 - DNA, 675 bp, Homo sapiens
  misc_feature: GYAE6OF01B2YRI.43.28.C06.1.454.CMB.1.raw
  modified_base (222)..(222): a, c, t, g, unknown or other
  misc_feature (222)..(222): n is a, c, g, or t
  modified_base (364)..(364): a, c, t, g, unknown or other
  misc_feature (364)..(364): n is a, c, g, or t
  modified_base (631)..(631): a, c, t, g, unknown or other
  misc_feature (631)..(631): n is a, c, g, or t
tcagtgtgagtagtcacgaccggtgctcgatttagagctcacgtattgggtttgggctgagctgggttttcctcgttgctcttttaagaggtgtccagtgtcaggtgcacatggtagagtcgtggggggaggcgtggtccagccgtggggcgtccctgagactctcctgtggagtctcgtgggttcaccctcaaataaacatggaatgcacgtcgggtcccnccaggctccgaggcgaaggggctggaggtgggtggcacgaaacatcatctgatggacgacaataaatactacgacagactaccggtaacggccgttcaccatctaccagggacaacttaccaagaacacgactagtatttanacaaagtggacacgcctagaagaaggtaggacggtactcggactatacgtaatttagttgtagacgaggtagagtagtacgtgtacgttagtacgttcgttacggttacgggagggtaggttattaggtacgtacggttacggggacccggtaacgggtaccccgtcgggtaccctaccggttccttcccgtcgtacccgtccctacccgaacccgaaccgggtacccgaccggttcccggtttccccgttccccgtccgggtcccnccccggttcgacccgttacccggacgggccgccgtaacccccgg

SEQ ID NO: 279402 - DNA, 739 bp, Homo sapiens
  misc_feature: GYAE6OF01CIEII.43.28.C06.1.454.CMB.1.raw
  modified_base (117)..(117): a, c, t, g, unknown or other
  misc_feature (117)..(117): n is a, c, g, or t
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (617)..(617): a, c, t, g, unknown or other
  misc_feature (617)..(617): n is a, c, g, or t
tcagtgtgagtagtcacgaccggtgctcgatttagagctcacgtattgggtttgggctgagctgggttttcctcgttgctcttttaagaggtgtccagtgtcaggtgcacatggtanagtcgtgggggaggcgtggtccagccgtggggcgtccctgagactctcctgtggagtctctgggttcaccctanaataaacatggaatgcacgtgggtccnccgaggctccgaggcgaaggggctgggaggtgggnggacaacaaacntcagtctgatggacgacaaataaataccgtacgactacgaccgtaccggtaaacggggtcccggttacgacccgtatcctaccgaagggacctaaacgttaccgaaacgaaccaacctactgttactttacgacaaagttcgaacgtacgtccgtagaaggtaacggtagacggtacgtcggtacgtaagttacggtaaatttagttacggtggtaaccgaggaacggtagtacggtacgtacggtaacgttgtcgtttaccgtcggggttttaccgagggtacgttagttagtacgttacggcgggtaccggaacgggttacccgtcggtacctacccgttcgtaccccgnacccggtccgtaccccaacccggtaaacccggtccccgtaccggtttacccgtcccccgttacccccggcggtccccgtcccgtccgtaccgtaccccgtaacgggacctcccgtaccccgg

SEQ ID NO: 279403 - DNA, 629 bp, Homo sapiens
  misc_feature: GYAE6OF02FRQN2.43.28.C06.1.454.CMB.1.raw
  modified_base (217)..(217): a, c, t, g, unknown or other
  misc_feature (217)..(217): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
tcagtgtgagtagtcacgaccggtgctcgatttagagctcacgtattgggtttgggctgaggctgggttttcctcgttgctcttttaagaggtgtccagtgtcacggtgcacatggtagagtctgggggagcgtggtccagcctggggcgtccctgagactctcctgtggagtctctgggttcaccctcaataaacatggaatggcacgtgggtccnccaggctccagggcaaggggctggagtgggtgcacaaacatcatcgtagatggacgcaaataaatacctacgcagactccgtaaagggccgttacaccntctccgaggacattccaanaacacactntattgactaaagtgganagcctagagagtgacgacgtcgactagtgttattagttgtgacgagagtatggacgtggacttaggtctttcgttacggtttacggacggttaggttattcgtaacgttacgtcggggacccgtaaggggtacccttgggtaccgtacccgttcctacccttcgaccgtaccctacccgacccgacgggacccctacggttccggtccccgttaccccgtcggccccgtcccgtcggtcccgtaccgacgggtactcccgtaacccgg

SEQ ID NO: 279404 - DNA, 1003 bp, Homo sapiens
  misc_feature: GYAE6OF02JQW41.43.28.C06.1.454.CMB.1.raw
tcagtgtgagtagtcacgaccggtgctcgatttagagctcacgtattgggtttgggctgagctgggttttcctcgttgctcttttaagaggtgtccagtgtcaggtgcacatggtagagtctggggggaggcgtggtccagccgtggggcgtccctgagactctcctgtggattctcgtgggttccaccctcaataaacatggaatgacacgtcgggtccgccgaggcctccgaggcgaaggggctagggaggtggggtggaccaacgaaacagtcatctgagtcggacacgaaataaacgtactaacggacaacgtaaccgtaccgggtaaacggggtcccggttaaccacctacgttccgtaccgaacggggtaaacctaacgttaacccgaaacgtaaaccaacctaacgttacgttaagtttacggaacgtaaaacggttacggaacaccggtacccgtaaggtaaacggtaacggtacggtaacggaaccgttccgggtaaacttaaggttacgtttaaacgttttaagtttacgggttaacgggaccgggtaaggtaacggttaaaggtacggttaaccggttaaggggtaaccgtttacggttaaccgttttttaccgggtttacccggggtttaaccgggggttaaaggggttaaacgggttttacggtttaaccggggttaaaccggtttaacccggggtttaacccgggggggtaaccccgtaaaccggggggtttaacccccgttacggggttaccccggtaacccccggtttacccgtttacccgttacccggtaaccccgttacccccgttaaccccggtaaccccgggtaaccgggttaacccccgttaaccccggggtttaaccccgggttttaccccccggttacccccccgggtttaaccgggccccccggtttaacccccggttccggttaacccccgggtaccccggtaacggggttaccccgaccccggtttaaccccccggg

SEQ ID NO: 279405 - DNA, 503 bp, Homo sapiens
  misc_feature: GYAE6OF01CDCAP.35.9.A09.1.454.CMB.1.raw
  modified_base (491)..(491): a, c, t, g, unknown or other
  misc_feature (491)..(491): n is a, c, g, or t
tcagtacagatcgtcacgaccggtgctcgatttagcgagacgcgcagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaagcccccaaactcatgatttatgatgtcagtaatcggcctcaggggtttctaatcgcttctctggctcaagtctggcaactcggctccctgacaatctctgggctcgggctgaggacgaggctgattattattgttgctcatatgcaggtagtagcactaatgtcttcggactggacaggtcacgtctaggtcagcccagactcgccccctggtcnctctgttccccg

SEQ ID NO: 279406 - DNA, 514 bp, Homo sapiens
  misc_feature: GYAE6OF01BR12V.35.9.A09.1.454.CMB.1.raw
  modified_base (360)..(360): a, c, t, g, unknown or other
  misc_feature (360)..(360): n is a, c, g, or t
  modified_base (468)..(468): a, c, t, g, unknown or other
  misc_feature (468)..(468): n is a, c, g, or t
tcagtacagatcgtcacgaccggtgctcgatttagcgagacgcgcagggggggtctcaggaggcagcgctctcgggacgtctccaccatggcctgggctctgctattcctcaccctcctcactcagggcacagggtcctgggcccaggtctggccctgactcagcctgcctccgtgtctgggtctcctggacagtcgatcaccatctcctgcactggaaccagcagtgacgtttggtggttataactatgtctcctggtaccaacaccaccaggcaaagcccccaaactcatcgatttatgatgtcagtaatcggcctcagggtttctaagtcgcttctctggctccaagtctggcaacncggcctcctgaccatctcgtcgggctccgaggctgacgtacgaggctagattacttactgcagctcatatacaacagcagcactctcgtgtcggcggaggaccaagcncgaccgtctcggcacgacccgaaggcctacgccccctggtctaccg

SEQ ID NO: 279407 - DNA, 518 bp, Homo sapiens
  misc_feature: GYAE6OF01BPJNK.35.9.A09.1.454.CMB.1.raw
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaagcccccaaactcatgatttatgatgtcagtaatcggcctcaggggtttctaatcgcttctctggctccaagtctggcaacacggcctccctgaccatctcgtgggctccaggctgacgacgaggctgattattactgcagctcatatacaaccagcagcactctcgtgttcggcggaggaccaagcgtcgaccgtccgtaggtcacggacccgaaggcctacgcccccctcggtctacccg

SEQ ID NO: 279408 - DNA, 494 bp, Homo sapiens
  misc_feature: GYAE6OF01DKFYC.35.9.A09.1.454.CMB.1.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
tcagtacagatcgtcacgaccggtgctcgatttagcgagacgcgcagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccaccaggcaaagcccccaaatcatgatttangatgtcagtaatcggcctnagggtttcaatcgcttctctggctcaagtctggcaacncggcctccctgaccatctctgggctccgaggctgacgacgaggctgattattactgcagctcatatacaagcagcagcactctcgtgtcggcggaggacagctgaccgtcgaggtcacgccaaggctcgccccgtcggtacc

SEQ ID NO: 279409 - DNA, 511 bp, Homo sapiens
  misc_feature: GYAE6OF01DSP56.35.9.A09.1.454.CMB.1.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacaccaccaggcaaacgcccccaaatcatgatttangatgtcagtaatccggcctgtagggtttctaatcgtcttctctggctcaagtctagcaacncggcctcctgaccatctcgtgggcctccgaggtcctagaccgacgagctgtattattactgcagctcatactaacaacagcagcactctgtgtcggcgacggaccagctcgaccgtcgtacgcacgacccgaggcctccgcccctgtcctaccg

SEQ ID NO: 279410 - DNA, 546 bp, Homo sapiens
  misc_feature: GYAE6OF01C1PUC.35.9.A09.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (497)..(497): a, c, t, g, unknown or other
  misc_feature (497)..(497): n is a, c, g, or t
tcagtacagatcgtcacgaccggtgctcgatttagcgagacgcgcgaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgtatactntgtctctgtaccaacaccaccaggacaaacgcccccaaactcactgtactttatcgatgtcagtaatcggcctctaggggtttctaatcgtcttctctggctcctaagtctggactaacaccggtccctccctcgaccctatcctcgtgggcctccgacggctggaaccgacgtacgggacttagtatttattactgcagctcatatacaagcagtcagcactactcgtgtcggacggacggtaccagtcgngtaccgttcgtagtccgacgtcccaaggccctccggccccgtgtacccg

SEQ ID NO: 279411 - DNA, 644 bp, Homo sapiens
  misc_feature: GYAE6OF01A817M.35.9.A09.1.454.CMB.1.raw
  modified_base (319)..(319): a, c, t, g, unknown or other
  misc_feature (319)..(319): n is a, c, g, or t
  modified_base (387)..(387): a, c, t, g, unknown or other
  misc_feature (387)..(387): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccaccaggcaaacgcccccaaaactcactgatttatgatgtcagtaatcggcctnagggtttactaatcgcttctctaggctccaagtctggcaacacggtcctcctgaccatctctggctcngctgacgacgagctgtattacttactgtacacgtaccgtctaattaactaacgtaaacgggaccaacggaccaacgggtaccttaaaccgttcccgttcgggttaacggtttccggggaccgggtaacggggtaaccccaaaagggttccgtacgggttaaaccccggttcccgtaaacggggttaccccaaacggtcccccggtaaaacggggtacccctttcccggtccccccccggttacggggtttaaccccc

SEQ ID NO: 279412 - DNA, 521 bp, Homo sapiens
  misc_feature: GYAE6OF01DJZB4.35.9.A09.1.454.CMB.1.raw
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (462)..(462): a, c, t, g, unknown or other
  misc_feature (462)..(462): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttatactntgtctcctggtaccaacaccacccaggcaaacgcccccaaactcactgattttangatgtcagtatcggccctcgaggggtttctaatccgcttctctcggctccaagtctggcaacncggcctccctgaccatctcgtggcctccaggctgacgacgnggctgatttatatcgacagctacattataacgaagcagcagcactcgtgttggtcggnggacggacagcgtgaccgtccgaggtcacgacccgaaggtcctccgccccgtggtaccc

SEQ ID NO: 279413 - DNA, 733 bp, Homo sapiens
  misc_feature: GYAE6OF01BCA4P.35.9.A09.1.454.CMB.1.raw
  modified_base (226)..(226): a, c, t, g, unknown or other
  misc_feature (226)..(226): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctaggacagtcgatccaccatcctcctgccacgtcggaaccngctaggtgacggttggtagttataactagtcgtcctccgtaggtaaccaaacgtaccacccgaggaccaaaacgcccccctaaaactcaattgtaactttagtcgtatacggtctaaggttaactccggtacccttacggtaacgggttttacctaacgtccgtccttactcggttaccggtctaccgtaagtccgtacgtacccaaaccgtccggtccccttcccgtaaggacccttacgttccgtccggtacgggtcctaccgtaggtcctacgggaacgtacggtacggtctaagttacttacgttacgtcgacgtacgtcctacgtaactaactaccgtaaccgagtaccgtaacgtccgtaccgtttcgtacgggttacggttaccgggacggtaacgggtaccctaaacggtccgtacggtaccccggttacgtacggtacccgtaacgaccccgttaacggtccccgttacccgtcccccggttcggttacccgtacccg

SEQ ID NO: 279414 - DNA, 742 bp, Homo sapiens
  misc_feature: GYAE6OF01BN2S1.35.9.A09.1.454.CMB.1.raw
  modified_base (241)..(241): a, c, t, g, unknown or other
  misc_feature (241)..(241): n is a, c, g, or t
  modified_base (307)..(307): a, c, t, g, unknown or other
  misc_feature (307)..(307): n is a, c, g, or t
tcagtacagatcgtcacgaccggtgctcgatttagcgagacgcgcgaggggggggtctcgaggaggcacgcgctctcgggacgtctccaccatggcctgggctctgctattcctcaccctcctcactcagggcacgagggtcctgggcccagtctgccctgactcagcctgcctcgtgtctgggtcctcctggacagtcgatcaccatctcctagcacgtggaaccagcagtgacgttggngctgataactatgtctctggtaccaacaccaccaggacaaacgccccaaacgtccatgactttagngatgtacagtaactcgcctacgtagggtttactaagtcgtacttctcgtacgggtctaccgtaacgtcgttacggtacgaaaccgtaacccggtcccgttaccccgttacgaacccgttaacgttccgttaccggtcggggtacctacccggtaacgggtccgttaacggaaccggaacggtacggtacgtacggtaacttttaacgttacgtacggtacctaagtaccgtacgtaacttaaaccgttaacctaaaccgtaacgggaccctaacgtaccgtaaccgttccgttaccggttacgggttaccgggtaccggggaaacgggtacccgtaaacggtaccggttacggtaaccccggttaccggtaacgggttacccgaaacggtaccccgtaaagggtacccgtacccggtccccccggttaacccggg

SEQ ID NO: 279415 - DNA, 679 bp, Homo sapiens
  misc_feature: GYAE6OF01CANPH.35.9.A09.1.454.CMB.1.raw
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatcctcctgcactaggaaccagcagtgtacgttggtgttaatactatgtctctgtaccaacaccaccaggacaaacgccccaaactcatgtactttatgatgtactaagtaactccggcccttcgtaacggggttttactaaacgtccgtcgtttctcgtcggtacctaccgtaaagttccgtaggaccgtaaccgacccggtaccccttcccgtacggtaacctacgttccgttcgtcgggtaccctccggacggtctacggaccgtaacggcggtacttagtaactttattacgtcgtactacgtcttacgtaattaactaacaaagtcgaacgtcaacgcttacttacgtcggttacggtccggggaacggaacggtaaccggtaacgtccgtaccggtaacccgtccggttaggtacccgaaccgtaccccggaacggtccccgttaccccggcccccgttggtaacccccg

SEQ ID NO: 279416 - DNA, 533 bp, Homo sapiens
  misc_feature: GYAE6OF01D2453.35.9.A09.1.454.CMB.1.raw
  modified_base (360)..(360): a, c, t, g, unknown or other
  misc_feature (360)..(360): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccagcaaacgccccaaactcatgatttatgatgtcagtaatccggccctcgtagggtttctaatcgcttctctggctccaagtcgtggcaacnccggcctccctgacccattcctcgtcgggcctccgacggctagacgacgtagctagtattatactgctagctactactaataccaacacgcacgcactcgttcgtgtcgggcggacgggaccagtcgtacgaccgtcgtagaccgacgacccgaaggcctccgccccgtacgg

SEQ ID NO: 279417 - DNA, 550 bp, Homo sapiens
  misc_feature: GYAE6OF01CX186.35.9.A09.1.454.CMB.1.raw
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgttatactatgtctcctgtaccaacaccacccagacaaacgcccccaaatcatgatttangatgtcagtactcggccctgtagggtttctaatcgtcttctctgctcagtcngacaacgcgcctcctagacctatctcgtcggcctaccgnggctagacgacgaggtctagtatttatactgacngctcataactacaaccagcagctactcgttcgtggtccgggcggtaacggacctacggcgtacggacccgttacgtcggtacccaccggacccgtaacggccctacccggtcccccttggtcctacccg

SEQ ID NO: 279418 - DNA, 538 bp, Homo sapiens
  misc_feature: GYAE6OF01EJ84C.35.9.A09.1.454.CMB.1.raw
  modified_base (113)..(113): a, c, t, g, unknown or other
  misc_feature (113)..(113): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
tcagtacagatcgtcacgaccggtgctcgatttagcgagacgcgcagggggggggtctcaggaggcagcgctctcgggacgtctccaccatggcctgggctctgctattcccnccaccctcctcactcagggcacgagggtccgtgggcccagtcgcggccctagactcagcctgcctcgtgtctggtctctggacagtcatcaccatctctgcactggaaccagcagtgacgttggtaggttaataactgtcgtcctctacggtaaccaacacccgaaccgaggaacaaaccgacccccaaatcaattgtatttagtgatggtanagtacgcgtcctgtagggtttcatcgcttctcgtgctacagtcngacaacncgctcgnacntctcgtgggctccgagtcngacgacgtaggcttagattactcngactgcctatcaacaacaacganacngctactcgtcgtcggtcggacggacgacgacgcgtcgtacgacgtacgacgacgaccgacgtaccgtccgcccgtcgtcgtc

SEQ ID NO: 279419 - DNA, 809 bp, Homo sapiens
  misc_feature: GYAE6OF01CR2FX.35.9.A09.1.454.CMB.1.raw
  modified_base (230)..(230): a, c, t, g, unknown or other
  misc_feature (230)..(230): n is a, c, g, or t
tcagtacagatcgtcacgaccggtgctcgatttagcgagacgcgcaggggggggtctcgaggaggcagcgctcgtcgggacgtctccatcatggcctggctctgctattcctcaccctctcactcgagggcacgagggtcctgggcccagtctcgccctgactcagcctgcctccgtgtctgggtcctccgtggacagtcgatcacctatcctcctgccacgtggaaccngcaggtgtacgtttgggtgttaataactatggttcctccgttacggtaaccaaaccgacccaacccacggacaaaaccgaccccccaaactcactgtaactttagtgattacgtactaagttaaactccggtaccctcggttaacggggttttactaaacgttccgtctttcccgtcgttacggccttaccgaaacggttcgtacgggaccctaaaccggtaacccgggtccccttacccgtcggaaccctacgttcctaccggtcgggtacccgtacccggaccgggtccgtaccgggtaacccgggaacggtaccgggtaccgttacgttaacgtttaacgtttacgtcggtaccgtacgtaccgttacctaacttaactaacccgaaccgaacgacctacggtacccttaaccgttccggttcggtttaccggttaccgggggaccggggaaaccggggtacccgtaacgggttacccgtaccgggtaaccccggttacccggttaacggtacccggaaccggtaccccggtaaacggccccgtaccccggtccccccggttcgggttaacccccg

SEQ ID NO: 279420 - DNA, 518 bp, Homo sapiens
  misc_feature: GYAE6OF01AM9FH.35.9.A09.1.454.CMB.1.raw
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (503)..(503): a, c, t, g, unknown or other
  misc_feature (503)..(503): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaccaccaggcaaacgcccccaaactcatgatttangatgtcagtaatcggccctcgtaggggtttctaatcgtcttctctgctccaagtctggcaacncggcctaccctgacccatctcgtcgggcctccgaggctgacgacgaggctgtattattactgcagctcatatacaagcagcagcactctcgttgtcggcggacggacagtctagacccgtctacggcacgtacccgaggcccncggccccctggtccc

SEQ ID NO: 279421 - DNA, 528 bp, Homo sapiens
  misc_feature: GYAE6OF01EYDLS.35.9.A09.1.454.CMB.1.raw
  modified_base (381)..(381): a, c, t, g, unknown or other
  misc_feature (381)..(381): n is a, c, g, or t
  modified_base (436)..(436): a, c, t, g, unknown or other
  misc_feature (436)..(436): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaacgcccccaaactcatgtatttatgatgtcaagtaactccggtcccttcgtaggggtttctaaatcgtcttctctggctccaagtctgcaacgacgcctccctnaccatctctgggcctcgaggctgacgacgaggctgtattatctgcagctacatanacaacagcagcactctcgtgtcggcggacggaccaggctcggtaccctcgtacggcacgacccgaacggcctaccgcccccgtgtcctcccg

SEQ ID NO: 279422 - DNA, 709 bp, Homo sapiens
  misc_feature: GYAE6OF01DK9WZ.35.9.A09.1.454.CMB.1.raw
  modified_base (301)..(301): a, c, t, g, unknown or other
  misc_feature (301)..(301): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctggcccagtctgccctgactcagcctgcctccgtgtctgggtctcctggacagtcgatcaccatctcctgcactggaaccagcagtgacggttggtgttatactatgtctccgtggtaaccaacaccgaccaggacaaacgcccccaaatcatagtatttangtatgtacagtactcgccctagtacgggtttactatcgtcttcgtactggtcctacagtctaggaccaaccgccggtccctcccgtacgaccctacgtttccgtccggtcgggtacctacccgacgggtccgtaaggaacccggacggtacggtacgttaggttaactttaacgtacgtcgtactacgtctactaatactaacgaacgtaccacgacctacgtaaccgtaccgttaccggttacgggttaccgggttacccggggaccggggtaaaccggtaaaccggtaaccggtacccgggtaccggttaaccccgggttccggttaaaccggggtaccctaacccgggaccccggtaaacccggtcccgttacccccgggttaccccccgttgggttaacccccc

SEQ ID NO: 279423 - DNA, 719 bp, Homo sapiens
  misc_feature: GYAE6OF01ER7F9.35.9.A09.1.454.CMB.1.raw
  modified_base (217)..(217): a, c, t, g, unknown or other
  misc_feature (217)..(217): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatcaccatctctgcactggaacngcagtgacgttggtgttatattctgtctcatcggtaacccaacaactacccgaggcaacgaccgacccccaaatcatgtatttatgatcgtactagtaacgtccgtacccgttggtacgggtttacctagtccgtcttaccgtcgtcggtcctaccgtaacgttcgtacggaccaaccgtaccggtcccttacccgtacgaccctaccgttccgtacggtccgggtccgtaccgacgggtacgtacggaaccggacgaggtacctaggttaactttagttacgtcgaccgtagtacccttagtaaacgttaactaaccgaacggtacctaacggacctaaccgtccttaacccggttccgtaaccgggttccgggttaccggggtaaacccgggacgggtaaacccgacgggtacccgttacccggggtaaccccgtacgggttaacccgggacctaaccccggacccggtaaccggtccccggttcccccggtacccccgg

SEQ ID NO: 279424 - DNA, 531 bp, Homo sapiens
  misc_feature: GYAE6OF01B0N86.35.9.A09.1.454.CMB.1.raw
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagtacagatcgtcacgaccggtgctcgatttagcgagacgcgcagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccaccaggcaaacgcccccaaactcatgatttatgatgtacagtaactcggccctcgaggggtttctaagtcgcttctctgctcaagtctggcaacacggcctcctgacctatctcgtgggctccgaggctgacgacgagctgattattacngcagcctnatataacagtcagcagccacttcgtcgtcgttcgggcggacggaccaagtccgtacgacccggtctaggtccgacgtacccgagggccctccgtcccccgtggtaccc

SEQ ID NO: 279425 - DNA, 609 bp, Homo sapiens
  misc_feature: GYAE6OF01B7H1S.35.9.A09.1.454.CMB.1.raw
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (588)..(588): a, c, t, g, unknown or other
  misc_feature (588)..(588): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccagcagtgacgttggtgttatactntgtctctgtaccaacaccaccgagacaaacgaccccaactcatgtactttangatgtcagtactcgcctgtaggttctatcgtacttctcgtgtcctactaagtcgtaggaccaaaccgccggtccctcccgtacgaccctacgttcctcggtacgggtccctccgacggtcctacggaaccggacgtacgggtcttagtaactttacttacgtcgactacgacttcgtaattagtaacgaacgacgaacgcgtacgtactaccttcgtcggttcggtacggacgggacgtaaccgacgtccgtacggtaccgtcgtacggtaccgaccgtacccgaacggtcccncccggtccccgtccgtacccg

SEQ ID NO: 279426 - DNA, 772 bp, Homo sapiens
  misc_feature: GYAE6OF01DGL0N.35.9.A09.1.454.CMB.1.raw
tcagtacagatcgtcacgaccggtgctcgatttagcgagacgcgcgaggggggggtctcaggaggcagcgctcgtcgggacgtctccaccatggcctgggctctgctattcttcaccctcctcactcgagggcacgagggtcctgggcccagtctgcccctgactcagcctcgcctccgtgtcgtgggtctccgtggacagtcgatccacctatcctcctgaccacgtacggaaccagccgaggtacggtagtttgggtttagggggttactcgtaccttgttccgttccgttggtactacaacgacgaccaccgaggaccaaaccgaccccctaaattactttaattaacgaacgtaccaactaacgccgtaccgtaggtaaggtactttactattccgtactttccgtacgtcgtacctaccgtaacgttcgtacgacctaaccggtcccgtccccttaccgtacgtaacctaacgttccgttccggtcgggtcccgtccgggtacgttacgggaacgggacgtacggtacgtttagttaacttttaagtttacgtttacggttctacctttagtaagtttacgtaggtaaccgttagggtaacgtaacgaccttaacgttagtttaccggttacgttaaccgggtaacggtacgggtaacctaaccggttacccaaccggttaccgtacggtacccgacccggaacccaccggtaccccaaccgtccgttacgtaccctacttccccgttcccgttaccccgtaccccg

SEQ ID NO: 279427 - DNA, 817 bp, Homo sapiens
  misc_feature: GYAE6OF01A0EWO.35.9.A09.1.454.CMB.1.raw
  modified_base (245)..(245): a, c, t, g, unknown or other
  misc_feature (245)..(245): n is a, c, g, or t
tcagtacagatcgtcacgaccggtgctcgatttagcgagacgcgcagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttataactntgtctcctggtaccaaccaccacccgaggaccaaacgcccccaaactcatcgtatttatgatgtacgtagtaacgtccggtccctacgtacggggttttacctaacgttccgtcctttcctccgttcggtccttaccgtaaggttccgttagggaccctaaaccggaacccgggtccccttaccccgttacgaaccccgtacgttcccgttcggtccggggtacctacccggtaacgggtccgttacgggaaaccgggtaaccgggtacggtaccttaacgggttaacttttaaacgtttaccggttacggtaccgtaacggtacccttaacttaacgttaaaccgtaaaccgaaaccggtaccaacgggaacccgtaaacggttaccccgttaaccgttccggtttaccggggttaccggggtttacccgggggaaccggggttaaacccgggaacccggttaaacgggtccgttaccgggtaaccccggttaccggtaaccgggttacccgaacccggtacccggaccgggtaccccgttccccggtacccccggttccggttaaccccg

SEQ ID NO: 279428 - DNA, 698 bp, Homo sapiens
  misc_feature: GYAE6OF01AJP7O.35.9.A09.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactggaaccngcagtgtacggttggngctagaacttaactatgtctccgtacggtaaccaaccaccaccgacggaccaaaccgacccccaaactcatagtatttangtatcgtactaacgtaacgtccggtccctacggtacggggttttacctaagttccgtctttaccgtcgtcggtaccttaccgtaagttccgtcggtaaccaaccgtaccggtccctcccgtcgacctacttccgtcgttcggcctcgtacgggtctacgaaccggacggtacgtactagttaacgtttacttaccgtgacctacgtactactaacttaacctaaccaaacccgtagtaccacgtacccttaaccttcggttaccggttacgggtccgggtacgggaacgggaacccgtaaccggtcggtacccggtaccggttaccgtaacggacccgtacggacccgtaaggtcccgtccccggtccccgttacccgg

SEQ ID NO: 279429 - DNA, 681 bp, Homo sapiens
  misc_feature: GYAE6OF01EXMOF.35.9.A09.1.454.CMB.1.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcaggcacagggtcctgggcccagtctgccctgactcagcctgcctccgtgtcgtgggtctccgtggacngtcgatcaccatctcctgaccactcggaaccngcaggtgtacggttggtgttataactntcgtctctggtaccaacaccaccagacaaacgacccaaactcatgtatttngtatcnctaagtaactccggtaccttcgtaggggtttactaactcgtccttctcgtcgtctaccgtagtcgtacggacctaaccgtaccggtaccctaccctaccgtaaccattccgtccgtcgggtcctcccgacggtctacgtaccggaccggtagtcgtagttacgttaacttcgtcgacctacgtctacgtaactaactaacgaacgacgacgcgtacgaccctcttacggttccggttggttaccggggacccgggtaaagggaacccgaacgggttacccgttacggtaccccggttacgttaaccgggtcccgtaaccggtaccccggaacgggtcccgttcccccgggtacccccgttcgggtaccccg

SEQ ID NO: 279430 - DNA, 825 bp, Homo sapiens
  misc_feature: GYAE6OF01EDXD7.35.9.A09.1.454.CMB.1.raw
tcagtacagatcgtcacgaccggtgctcgatttagcgagacgcgcgaggggggggtctcaggaggcagcgctctcgggacgtctccaccatggcctgggctctgctattcctcaccctcctcactcagggcacgagggtcctgggcccagtctgccctgactcagcctgcctccgtgtcgtgggtcctccgtggacagtcatcaccatcctcctgcacgtcggaaccagcaggtgtacggtttgggttacggttaataacttagtcgttccttccgttacggtaacccaaacctaccccgaacccgaacgggaaccaaaacccggccccccctaaaaactcctaattacgttaatttaatcgtaagttcgtacgtaagttaacgtccccggtacccgttacgggttaacggggttttacctaaacgttccggtacctttcgtccgtacggtaccttaccgtaaggttccgtcggtacccaaaaccggtcccggtccccttacccgtacggtaaccctacgtttcccggttccggtacggggtcccttacccggaacgggttccggtaacggtaaccgggtaaccgggtacggttacgttagtttaaacgtttactttaacggtcgtaccgtacgtaccgttactaacgttaactaccgaacgtccgtaacggcctaacgtacccttaccgttcgggttccggtacgggttccgggggaaacgggtacggaaccgtacggtaccgtaccgggtacccggttcgtaccgggtaccgacccgggtacctaaccgggacccttccccggtaacccgtccgttaaccccg

SEQ ID NO: 279431 - DNA, 726 bp, Homo sapiens
  misc_feature: GYAE6OF01DOJ60.35.9.A09.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
tcagtacagatcgtcacgaccggtgctcgatttagcgagacgcgcgaggggggggtctcaggaggcagcgctctcgggacgtctccaccatggcctgggctctgctattcctcaccctcctcactcgagggcacgagggtcctgggcccagtctggccctgactcagcctgcctccgtgtcgtgggtctccgtggacngtcgatccacctagtcctcctgcctacgtaggaaccngctagtcgacgttggtagttaactaactntcgtctccgtagtaaccaacaccaccacgaccaaaccgacccccaaatcacgtagtaattttacgtgtagttacgtacgtaacggttaacgtcccgggtcccgttacgttaacggggttttaacctaacgttccgtctttccgtcgttcggccttacgtaagttcgacgtaccaacggtccgtccctcctacgacctacgttcgtacgtcggtacctccgtagccgtacgaaccggacggtacggtacttagtaactttacgtacgtacgactacgtactactaagttaactacgaaacgtcgaacgtccgtacggtctaccgttcgttcgggttacggtccgggaacgggtacccggtaacgtaaaccggtccgttaccgggtacccgttaaccgggtacggtacccaacccgggtaacccgcccggtacccgtaacccccggtccccgttccggtacccc

SEQ ID NO: 279432 - DNA, 702 bp, Homo sapiens
  misc_feature: GYAE6OF01ESN96.35.9.A09.1.454.CMB.1.raw
  modified_base (162)..(162): a, c, t, g, unknown or other
  misc_feature (162)..(162): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagtacagatcgtcacgaccggtgctcgattttagcgagacgcgcaggggggggtctcaggaggcagcgctctcgggacgtctccaccatggcctgggctctgctattcctcaccctcctcactcagggcacagggtcctgggcccagtctgccctgactnagcctgcctcgtgtctgggtctcctggacagtcatcaccntcctcctgcactggaaccngcagtgacgttggtagttaataactatcgtctaccgtaggtaacctaacacctaccgaggaccaaacgacccccaaactcaattcgtatttatgtactagtactaaggtaacttccggtaccgttcgtaacggggttttacctaacgttccggtactttacctcgttcgtaccttaccgtaagttcgcggtaaccgaaccggtacccggtcccttaccccgtacggacctacgtacctaccggttcggaccgttaccgtacgtcgtacggtacggaaccggaggtcgtagtaactttattacgttgtaactagtacctataatacgtaacgacgtacgacgacgacgtactacgttcgtcggttacggttcgggaccgggtaaggacccgtaagtccggttaaccgacccgttacggtaccggtaccgtaacccggtacccggacgttaccccgacccgttccccggtacggttaaccccg

SEQ ID NO: 279433 - DNA, 719 bp, Homo sapiens
  misc_feature: GYAE6OF01A49QQ.35.9.A09.1.454.CMB.1.raw
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
tcagtacagatcgtcacgaccggtgctcgatttagcgagacgcgcaggggggggtctcgaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacatcctcctgcactggaaccagcagtcgacgttggtgttataactntgttctcctggtaccaacacctacccaggaccaaacgcccccaaacgtcaatacgactttangtatgttacagtaactccggtaccctcgtagggtttcctaacgtcgtccttcgttctcggtccttccgtaagtccggtacgtccaaaccgtaccggtcccctcccgtaacgtaaccctcttccgtcgtcgggccttaccgacggcgttacggacggtaccggacggtcgtagttaacgtttactttacgtcggtaccctagtcctaacgtaacttaacgtaaccgtaagtaccgacggtaacgaacgttccgtaacctttccggtcggtttaccgggcggggtccgggtaaacgggtacccgaacgggtccgtaccgggtaccccggttaccgttacgggaccccaaccgggtccccgtaacggggttcccgaacccccgggttccccccggttccggttaacccccgg

SEQ ID NO: 279434 - DNA, 699 bp, Homo sapiens
  misc_feature: GYAE6OF01A6W23.35.9.A09.1.454.CMB.1.raw
tcagtacagatcgtcacgaccggtgctcgatttagcgagacgcgcaggggggggtctcaggaggcagcgctctcgggacgtctccaccatggcctgggctctgctattcctcaccctcctcactcgaggcacgagggtcctgggacccagtctcgccctgactcagcctgcctcgtgtcgtcggtctcgtggacacggtcatccgacctatccgtcctagacctacgtacggtaaccacgactaacggtcggtacggttttagggtaggttttaaactaacgttgttcgttcctaccgtacgtaaccaaccaccgaaccgacgaccaaaccaccccaactactagtacgtatttacgagtacgtacgtacgtaacgtacgtccgtacgtacggttacggtttacacgtctcgttccgtcgcgtcgtacgtacgtcgtacgaccgtaccgtccgtccgttaccgtacgtaactaccttcggtcggtacggtccgtacggtacgtacgggaacggtcggtacgtacgttagttaagtttacgtttagttcgttacgacttagtagtacgtgtacgtaaggtacgtactacgtacttacggtcgttacgtaccggtacgtacggacgtacgtaccgtacctagtacgtaccacggaccgtaaccgacccaccgttctacgacttccgtcccgtcccgtaccc

SEQ ID NO: 279435 - DNA, 755 bp, Homo sapiens
  misc_feature: GYAE6OF01CC85E.35.9.A09.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
tcagtacagatcgtcacgaccggtgctcgatttagcgagacgcgcgagggggggggtctcaggaggcagcgctctcgggacgtctccaccatggcctgggctctgctattcctcaccctcctcactcagggcacgagggtcctgggcccagtctgccctgactcagcctgcctccgtgtctgggtcctccgtggacagtcgatcaccatctcctgcactggaaccngcagtcgtacgttggtagttatactntcgtctcctacggtaaccacaccgaccaggaccaaacgacccccaaaccgtcatacgtatttagagtattgtacagttaacgtccggtaccgtacggtacgggttactacgtcgtacttcgtcgtcgtacctactaacgtcgtacggaccgaaccgacccggtcccgtacccgtacgtaacccgtacttccgttaccggtcgggtacccgtaccgtacgggtccgtacggaacccggtaaggtaccggtacgttagttaacgtttaccgtttaacgtacggacctacgtaccgttaactaacttaacgtaacgaaggtacccgaacgaccgtacgtaccgtacgttccggttacgggttacgggtaccgggggtacggtaacccgggaaacccgtaacgggtcccgttaccgggttaaccccggttccggtaaccggtacccgaacccgggtaccccgaacgggttcccggtacccccggtcccccggttccgggtacccccg

SEQ ID NO: 279436 - DNA, 834 bp, Homo sapiens
  misc_feature: GYAE6OF01DBGJ5.35.9.A09.1.454.CMB.1.raw
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
tcagtacagatcgtcacgaccggtgctcgatttagcgagacgcgcgaggggggggtctcaggaggcagcgctcgtcgggacgtctccaccatggcctgggctctgctattcctcaccctcctcacctcagggcacgagggtcctgggcccagtctgccctgactnagcctgcctcgtntctgggtctccgtggacagtcatccgacctntctccngcactggaaccngcgaggtgtacgtttgggtagttactaacttgtcttcctccgtacggtacccaaccaacccacccgagaaccgaaaccgacccccctaaaactcacgttagtaactttatagagttgtacgtaagtacgtaccggtcccttaccgggttagggtttacctacgtccgttccttctcgtcggtaccttaccaaggttccgtacggacctaaccgaccggtaccctcccctaggaccctagttacccgttcggtacgggtcccgtaccggtacggtacgttccggaacccggtaccggtacggtcgttacgttaacgttttacgtaaccggttccgaacgtaccgtaccgttacgtaaccttaacgttaccaaacgtacgaccgtaccgtaccgtaaccgttacttaccgggtttacggtttacccggggttacccggggtaacgggggtaaccccgggtaacgttaccccgggtaaccggttaccccggggttaaaccccgttcccggggttaaaccggttaaccccggaacccgggttacccggtaaacccggggttccccgtttaccccccgggttccccccggttaccgggtttaacccccccgg

SEQ ID NO: 279437 - DNA, 528 bp, Homo sapiens
  misc_feature: GYAE6OF02FV1V1.35.9.A09.1.454.CMB.1.raw
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
tcagtacagatcgtcacgaccggtgctcgatttagcgagacgcgcagggggggggtctcagggtagggcagcgctctcgggacgtctccaccatggcctgggctctgctattcctcgaccctcctcactcagggcacagggtcctgggcccagtctgccctgactcagcctgcctccgtgtctgggtctcctggacagtcgatcaccatctcctgcactggaacctgcagtgatgttgggaattatgactatgtctctggtaccaacttcacccagacacacgtcccccaaaacccatcgatcctaacaatgtacaatattccggcccttcaggacgtccctaaattccgttttctcgtggcttccaagtctggcttagtcgcggcccttccgtcgccccattcctcgtgggcctccgaggctgacgacgaggctgattattactgcagctcatatacaacngcagccactctcgtgttcggnggacggaccagcctagacctcgtagccagcccaggcctcgccccg

SEQ ID NO: 279438 - DNA, 537 bp, Homo sapiens
  misc_feature: GYAE6OF02IR0D5.35.9.A09.1.454.CMB.1.raw
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatattctgtctcatggtaccaacaatacccaggcagagcccccaaactcatgatttttgaggtcagtaagcggcctcaggggtccctgatcgcttctctggctccaagtctgacaacacggcctcccttaccgtctctgggctccagactgaggatgaggctagattattactgcagctcatatgcaggcagcctaaccgtttgtagttttcggcgggtagggaccgtaagttcgacccgttccgtaagtccgaacgtacccgaaggctcggcccccgtcggtccactccttcccgg

SEQ ID NO: 279439 - DNA, 611 bp, Homo sapiens
  misc_feature: GYAE6OF02GFOMA.35.9.A09.1.454.CMB.1.raw
tcagtacagatcgtcacgaccggtgctcgatttagcgagacgcgcaggggggtcgtcaggaggcagcgctctcgggacgtctccaccatggcctgggctctgctattcctcaccctcctcactcaggcacagggtcctgggcccagtctgccctgactcagcctgcctcgtgtctgggtctcctggacagtcgatcaccatctcctgcactggaaccagcagtgacgttgtgctgataactatgtctctggtaccacacaccaggcaaagccccaaatcatgacttatgatgtcagtaatcggcctcagggtttcaactcgcttctctggtctaccgtaagtcttggacaacaccggccttacccgtgaaccctatctcgtcgggaccttccgaaggtcctaggaccgaacgagggtcctaggactttaagttaccttcggactaggtacctttacaagttacgtaacctaaggacccaggtaccaacggtcctaccgtttacgtaccggttagtttccgggacggtacgggtaaccctaaggtcccgtagtacccggttaccgtaacggtaccgaccggacccctaacgggtcccttacgtaccccccgg

SEQ ID NO: 279440 - DNA, 507 bp, Homo sapiens
  misc_feature: GYAE6OF02IC0PD.35.9.A09.1.454.CMB.1.raw
  modified_base (222)..(222): a, c, t, g, unknown or other
  misc_feature (222)..(222): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaccaccaggcaaagcccccaaactcatgatttatgatgtcagtaatcggccctcaggggtttctaatcgcttctctggctcaagtctggcaacacggcctcctgaccatctctgggctccagctgacgacgaggctgattattactgcagctcatatacaagcagcagcactctcgtgttcggcggaggaccaagcgtgaccgtccgtaggtcacgacccgaaggcctcggccccctgtacccg

SEQ ID NO: 279441 - DNA, 522 bp, Homo sapiens
  misc_feature: GYAE6OF02HOZTF.35.9.A09.1.454.CMB.1.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanactatgtctcctggtaccaacaccaccaggcaaacgcccccaaatcaatgatttangatgtacagtaatcggccctcgaggggtttctaatcgtcttctctgctcagtctgcacncgcctccngacatctctggcctcgagctagacgacgngntagtattactactgacagctagatataacaagtcagcagactacgtcgtcgtgttcggacggaggaccaggctacgccggtaccgtaggtccacggacccgaggtccctccgtcccccgtggtccc

SEQ ID NO: 279442 - DNA, 591 bp, Homo sapiens
  misc_feature: GYAE6OF02GUQVL.35.9.A09.1.454.CMB.1.raw
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctggtaccaacaccaccaggcaaacgcccccaaatcatgatttangatgtcagtaactcggccctgtaggggtttcaatcgcttctctggcctccaagtctcggacaacgccggtccctccctcgacctactctcgtcgggctccgaggtcgtcgacggacgacgctgtactttatcgtgacagtcctacataactaacgaagtccgagacacgacctacttacgtccggttacgttccgggacggtacggggaacctaacggcgttaccggacccgttccggtaacggtcccaaccggtacccaacgggtccctacccggtccccccgtgggttacccc

SEQ ID NO: 279443 - DNA, 604 bp, Homo sapiens
  misc_feature: GYAE6OF02IXVCG.35.9.A09.1.454.CMB.1.raw
  modified_base (193)..(193): a, c, t, g, unknown or other
  misc_feature (193)..(193): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcaactggaaccagcagtgacgttggtggttaataactatgtctcctggtaccaacaccaccaggcaaacgcccccaaaatcaactagatttatgtatcgtcaagtaactcggccctcgtagggtttctaatcgtcttctctcggcctacctagtcgttcggacaacgacggaccccttcccgtacgtaccacttcgtctgggtcctacgtacggctcggacgacgagggcctagtacttagttactcgctacgcgtctagtaactaacgaagtaccagaccgagtccacgttctcggtagttccgggacggacggaccaagtccgtaacgggtccctaccgtacggccgtaaccgcccgtaaggtcccgtccggtacccccgtgggttacccc

SEQ ID NO: 279444 - DNA, 567 bp, Homo sapiens
  misc_feature: GYAE6OF02G91Y9.35.9.A09.1.454.CMB.1.raw
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaagcccccaaatcatgatttangatgtcagtaatcggccctcgaggggtttcaatcgcttctctggctcaagtctggcaacgcggcctccctgaccntcctntcggctccgnggcctgacgacgaggctgtattattactgcagtctactataactaacaagtccaagcacgaccaccttctacggttggttacgggccgggacgggaccgaacggccttacggtacccgtaccgtacgggtccgaccggacccggaacggtcccgtacccggtcccccgttcggtacccg

SEQ ID NO: 279445 - DNA, 649 bp, Homo sapiens
  misc_feature: GYAE6OF02J3HUQ.35.9.A09.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgacactggaaccngcagtgacgttggtgttatactntcgtctctgtaccacaccaccaggaccaacgaccccaactcatgtattatgtatagtctaacgtaacgtcggtcccgtcgtagggtttactaacgtcgtcttctctcggtctaccgaagtcgtcgacaacgtaccggtcctacccgtacgtaccctacgttccgtcggttcggcctaccgtacggtcgtcggaacgtacggacgtacgttagtacttaacgttacgtcgtaccgtagtacctagtaactactaacgtaacgaccgtacgacgtacgtccttacgtccgttcgtacgggttaccgggacggttaccgaccgtaacgccggttagacccggtttaccgacggtacccgaacgtcccggtaacgtccggtaccccgtacccgttccgtaaccccg

SEQ ID NO: 279446 - DNA, 712 bp, Homo sapiens
  misc_feature: GYAE6OF02H5MJ0.35.9.A09.1.454.CMB.1.raw
  modified_base (221)..(221): a, c, t, g, unknown or other
  misc_feature (221)..(221): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccngcagtgacgttggtagttataactatgtctcctggtaccaacaccaccagacaaacgcccccaaactcatgatttatgatgtacagtaatccggccctcgtaggggtttactaagtcgtcttctcgtcggcctccgtaagtctaggtaccaaacgaccggtcccttcccgtacggaccctactcctaccgttcggggacctcccgacgggtccttacggaaccggtaacggacgggtcgttagtaacttttaacgtttaaccgtcgtaccgacgtccgttaacgaacttaaccttaaccaaacccgtaagtacctaacgtaccctaaccttccgttaccggttacgggtttaccgggacggggtaaccgggaaccctaacggtccgtaaccggtaaccccggttaccgtaacgggttcccgaacccggtaccccggtaaacgggtcccttaccccgggtcccccgtttacccgggtacccttaacccccgg

SEQ ID NO: 279447 - DNA, 517 bp, Homo sapiens
  misc_feature: GYAE6OF02J0EIG.35.9.A09.1.454.CMB.1.raw
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagtacagatcgtcacgaccggtgctcgatttagcgagacgcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaacgcccccaaactcatgattacngatgtcagtaatcggccctgagggtttctaatcncttctctggctccaagtctggcaacncggtaccctcctgacctatcgtctacgggcctccgaggctagacgacgaggctcgattagtactgcagctcattactacacncgnagccaatctacgtgtcgacggacggaccagacgtcgaaccgttccaggtcacgcccgagtcctcgacccctcgg

SEQ ID NO: 279448 - DNA, 642 bp, Homo sapiens
  misc_feature: GYAE6OF02JMNLB.35.9.A09.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
tcagtacagatcgtcacgaccggtgctcgatttagcgagacgcgcagggggggtcgtcgagggaggcgagcgctctcgggacgtctccaccatggcctgggctctgctattcctcaccctcctcactcaggcacaggtcctggcccagtctgccctgactcagcctgcctccgtgtctgggtctccgtggacaggtcgatcaccntctcctgcactggaaccngcagtgacgttgtggttaataactntgtctcgtgtaccaacaccaccaggacaacgcccccaaatcatcatttangatgacagtaancgacctgaggttactatcgtctctcgtgcctctagtcngacaacgcggacctccgtagacccagttcctacgtcgggcctaccgaggtcctacggaacgtaggtacgcttacggtaatttaacgttcgtagtccgacgccttacaagtttaacaacccaaacgtcggaacctacgacctaccgttcttccggttacggttcccggggaacggtaacgggaccctaacggtccgttacccggggaaccctttacgttaaccgggtacccaacgggttacccccgaagggttcccctaaccccggggtcccccgttccgggttaacctacccgg

SEQ ID NO: 279449 - DNA, 622 bp, Homo sapiens
  misc_feature: GYAE6OF02FFT2A.35.9.A09.1.454.CMB.1.raw
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (299)..(300): a, c, t, g, unknown or other
  misc_feature (299)..(300): n is a, c, g, or t
  modified_base (455)..(455): a, c, t, g, unknown or other
  misc_feature (455)..(455): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctcgtgtctgggtctcctaggacagtcgatcaccntcctcctgccactcggaaccngcagtgacgttgtgttatactntntcnctgtaccaacnccaccaggaccaaacgcccccaaatcatgtatttannatgtcagtactccggcctggtagggtttcagtcgtctctcgtcgctacgatcgtagacacgccgcctccgtacgacctacgttccgtcggtcggccttccggaggtccgtacggaccgtacggtacggtacgttaacgtactttaacgttaccgngaccgtacgtcctaactaacgtaacctaaacgacgacgacgacctacggaccttaccgtcgttacggtggtaccgggacgggacgaaccacggtccgtacggacccgttagtaccgtaccgaccggtacccgaaccggtccctaccccggtcccgtacgttaccccg

SEQ ID NO: 279450 - DNA, 496 bp, Homo sapiens
  misc_feature: GYAE6OF02F0YVP.35.9.A09.1.454.CMB.1.raw
  modified_base (340)..(340): a, c, t, g, unknown or other
  misc_feature (340)..(340): n is a, c, g, or t
  modified_base (431)..(431): a, c, t, g, unknown or other
  misc_feature (431)..(431): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaatcatgatttatgatgtcagtaatcggcctcgaggggtttctaatcgcttctntggctcaagtctgcaacacggcctccctgaccatctcgtgggctccaggctgacgacgaggctgattatactgcagctcatactacaccancagcactctcgtgtcggcggaggaccagctgaccgtcgtagccacgcccaaggctcgcccctcgg

SEQ ID NO: 279451 - DNA, 519 bp, Homo sapiens
  misc_feature: GYAE6OF02FLV0F.35.9.A09.1.454.CMB.1.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaagcccccaaactcatgatttatgatgtcagtaatcggaccctcaggggttttctaatcgcttctctggctaccaagtctggcaacgacggcctccctgaccatctctgggctcaggctgacggacgaggctgattacttactgcagctnattanacagctagcagtcactctgtgttcggcggacggaacctaggctagaccgtcgtacggtcacgcccaaggcctcggcccccgtggtccc

SEQ ID NO: 279452 - DNA, 619 bp, Homo sapiens
  misc_feature: GYAE6OF02F3L92.35.9.A09.1.454.CMB.1.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttaataactatgtctcctggtaccaacaccaccaggcaaagcccccaaactcatgtatttangatgcagtatccggcctcgtagggtttctaagtcgtcttctctcggctccagtctggacaacgaccggtcctcccgtcgaccactccgtcgtcggggtcctccgagggcctcggaaccggtcgagggtaccttaggtaactttaacttacgttcgacctagtccttacgaattaacgtacgaacgcgagaccagcctacttcgtcgttcggttacgggaccgggacgggaccgtaacggtcgtaccgggtaccccgttccggttacggtccaccggtacccgtaaccgggtcctacccgggtccccccgtggttaccccg

SEQ ID NO: 279453 - DNA, 744 bp, Homo sapiens
  misc_feature: GYAE6OF02H8ZSE.35.9.A09.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
tcagtacagatcgtcacgaccggtgctcgatttagcgagacgcgcagggggggggtctcaggaggcagcgctctcgggacgtctccaccatggcctgggctctgctattcctcaccctctcactcagggcacagggtcctgggcccagtctgccctgactcagcctgcctcgtgtctgggtctcctggcagtcgatcaccntcgtctgcacgtggaaccngcagtgacgttggtncttnaataacctatcgtctcctaggtaccaaacgacccaccgaaggacctaaaacgcccctaaaactcaacgtatacgttttaatcgaattcgtactaacggttaaacgtccggtacccctggtaacgggttttacctaagttaccgtttcctcgtacggtaccttacctaaggttctcggtactaacgttcggccggtacccgttccgtcgacccctaattccgtacgttcgggtacctacccggtagtacctaggaacggtacgggacggtcgtacggttaattacggtttacgggacgtcctacgacttttaaagaagttaaacgtaacggtgaacggttacgtacccgttacgtttaccgtaacggtttaacgacggttttaccgggaccgggtaacgggtaaccctaaaggtaccgttaccggtaacccgtttacccggtacggttaccgaaccgggtaacccccgtaaagggtccctttaacccggcccccggtttaaccggg

SEQ ID NO: 279454 - DNA, 721 bp, Homo sapiens
  misc_feature: GYAE6OF02HCVJ1.35.9.A09.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagtacagatcgtcacgaccggtgctcgatttagcgagacgcgcaggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccntctcctgcactggaaccagcagtgacgttggtggttataactatcgtctcctggtaccaacaccacccaggacaaacgcccccaaactcatgtatttatgatgtacaagtaactccggtccctacgtacggggtttactaacgtcgtccttctcgtcggtctacctaagtccgtacggaccaacgaccggtcccttcccgtacgtaccctacttccgtccgttcggggtccttacccggaggtccgtacggaaccggtaacggtacggtcttaggtaactttacgttacctcggtaccacgtccttactaactaactaacgaagtccaacgtaccaacgtaccgtacctttccggttcggttacgggttacccgggaccggggtacggggtaacccgtaagggtcccgttaacccgggttacccggttacccggttaaccgggtacccgaacccgggtaaccccggtaaccgggttaccccggtaccccggttccccccgttaccgggttaccccg

SEQ ID NO: 279455 - DNA, 751 bp, Homo sapiens
  misc_feature: GYAE6OF02JFJYS.35.9.A09.1.454.CMB.1.raw
  modified_base (241)..(241): a, c, t, g, unknown or other
  misc_feature (241)..(241): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcagtcaccatctcctgcactggaacctgcagtgatgttgggaattngactatgtctctggtaccaacttcaccagacacacgtaccccaaaccatagactctaacaatgtacaagttcttccggccctgaacgggtacgttaccccttaaagttccgttttcctaccgttcgggtaccttacccgtaaaggtttcctacgggtaccttaggtccgggtcccggtccccgtttcccggtcgtaccccctatttcccgtccggttaccgggtaacccttcccggaagggtcccttagggaacggggtaacccgtacgggtcctttaaggtaaacgtttttacggtttacggggaacgttcccgtttaggtaaccgtttttaaagtaacgttaaacgggaaaccgttcgtaacgggttaccgaaccccgttaacgttttaccgtaacgggtttaacggtaccgttacgggggaccggtaacgggtaacctaaggttccgtacggtacccggtcgttacggtaccaccggtacccgaaggtcccgttacccgtaccccgg

SEQ ID NO: 279456 - DNA, 503 bp, Homo sapiens
  misc_feature: GYAE6OF02FTRDO.35.9.A09.1.454.CMB.1.raw
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaagcccccaaactcatgatttatgatgtcagtaatcgccctnagggtttcaatcgcttctntgctcaagtctggcaacacgcctccngaccatctctgggcctcgaggctgacgacgaggctgtattatactgcagtctacatataacaccancagcactctcgtgttcggacgacggacaagctcggaccgtcgtaggtcacgacccgaggctaccgccccgtacgg

SEQ ID NO: 279457 - DNA, 736 bp, Homo sapiens
  misc_feature: GYAE6OF02H7O36.35.9.A09.1.454.CMB.1.raw
  modified_base (265)..(265): a, c, t, g, unknown or other
  misc_feature (265)..(265): n is a, c, g, or t
tcagtacagatcgtcacgaccggtgctcgatttagcgagacgcgcaggggggggggtctcaggaggcagcgctctcgggacgtctccaccatggcctgggctctgctattcctcaccctcctcactcaggacacagggtcctgggcacagtctgccctgactcagcctgcctccgtgtctgggtctcctggacagtcgatcaccatctcctgcactggaaccagcagcgatggttggggtatgaccttgtcctctggtatcaacngccacccgaggacaaacgacccccaaaacttacttaaatttaagtaacggaactaacgtaacgccgaaccctcgaagggtactttacgtaactccgtcttcgtcgtacggtcctacgtaaacgtcgttacggtacctaaccgttccgggaccccttacccgtagaaccgtaacctcgtttaccgtcggggtaccgttccgggcgtacgggtagaccggtaggcgttagttaattttaagttaagtttcggttgttacctacgtaagttactacggtaccgtaaggttaacgggtaactactaaaccgttaattcggtttacgttaccgggttaaacgtacggggtaacccgtaagggtacccgtaacccgtttaccgggtaacggtaaccgaccggaaccccggtaaaccggacccctaaaccccgttaccgtacggtacccttaccgttccgttacccgtttaccccccc

SEQ ID NO: 279458 - DNA, 543 bp, Homo sapiens
  misc_feature: GYAE6OF02GMPQV.35.9.A09.1.454.CMB.1.raw
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtctcctggtaccaacaccaccaggcaaacgcccccaaactcatgtatttatgatgtcagtaatcggccctcgaggggtttctaatcgcttctctgctccaagtctgcaacncggcctccctgaccntctcgtggcctccgngccgtgacgacggaggctagtacttattactgcagtctacataatacaagtacagcacgcactctagttggttcgcgggacggaccaaggtctacggtacccggtcgtacgtacgacggacccgtaaggtcccgtccgtccccgtggtaccc

SEQ ID NO: 279459 - DNA, 767 bp, Homo sapiens
  misc_feature: GYAE6OF02HCNL4.35.9.A09.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagtacagatcgtcacgaccggtgctcgatttagcgagacgcgcaggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttataactntgtctcctgtaccaacaccaccaggacaaacgcccccaaactcatagtatttacngtatgtacagtaacgtcggccctacgtacggggtttactaacgtcgtacttctcgtcggtacctaccgtaagtccgtcggaactaaccgaccggtacctacccgtacgaaccctactaccgttacgtcggggtcccttacccggtacggtacgttacggaacggtacggtaacgggtaccgttaggttaacgttttaacgttaccgttaacgtacgtaacgttaccgtacctaaagttaaccttaaacgaaacgtaccgaaccggaccgtaacgtacccgttaaccgttaccgttacccgggttacgggttaccgggtaccgggtaaccggggtaaccccgtaaacgggtccgttaacccgggaacccggtttaacccggttaacgggtacccgtaaccggtaacccccggtaaaccgggtcccttaacccccgggttacccccggttaccggttaacccccgg

SEQ ID NO: 279460 - DNA, 719 bp, Homo sapiens
  misc_feature: GYAE6OF02FI6WS.35.9.A09.1.454.CMB.1.raw
tcagtacagatcgtcacgaccggtgctcgatttagcgagacgcgcagggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgccactggaaccagcagtcgtacgttggtggttaataacgtatgtcctcctcggtaccaaccaccaccaggaccaaacgcccccaaactcatacgtatttagtgattgtacgtaagtaacgtccggccctcgtacggggtttactaactcgtcttctcgtcggtcctacgaacgtcgtacggacaacgaccggcccttaccccgtcgtaaccgtacttccgtacgtcgggtacctccgacggtctacggaccggtaccggtacgggtccttaacggttaacttacgttaccgtcgaccttacggtacctactacgtaattaaccgaacgacacgaccgacgtacccgtacttccgttaccggttacggttaccggggtaccgggtaccggggaacccgtaacggtacccgttacccggtaacccggttacccggttacggtacccggacccggtaaccccggaaaccggtccccggtccccgggtacccccggttacccgggttaccccg

SEQ ID NO: 279461 - DNA, 621 bp, Homo sapiens
  misc_feature: GYAE6OF02F5RZ2.35.9.A09.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (386)..(386): a, c, t, g, unknown or other
  misc_feature (386)..(386): n is a, c, g, or t
  modified_base (532)..(532): a, c, t, g, unknown or other
  misc_feature (532)..(532): n is a, c, g, or t
tcagtacagatcgtcacgaccggtgctcgatttagcgagacgcgcaggggggggtctcgaggaggcagcgctctcgggacgtctccaccatggcctgggctctgctattcctcaccctcctcactcaggcacagggtcctggcccagtctgccctgactcagcctgccctcgtgtctcgggttctccgtaggacagtcgactcaccatctcctagcactggaaccagcagtnacgttggtagttanaactntgtctctgacacaccacagacaagccccaatnanctaattntgatgcagtaatccgcctgtagggtttacacgtcgtacttctcgtagtctccgtaagtcctaggacctaaccgcggccctaccctagtaacccncgtttactccgttcggtaccctacgtacgtcgtaaccggacggtacgaaggtccgttaaggttactttaacgtttacgcgaccgtaagtcctaaccgttaataccaacgacgacgtagctaacgctacgttctacggtacgtcggnggaacgtacccaggtctaccggtcccgtaaccttggtaccgaacccggtccgtaaccggtcacccccgggtaccccgttcggtaacccg

SEQ ID NO: 279462 - DNA, 788 bp, Homo sapiens
  misc_feature: GYAE6OF02GQXXA.35.9.A09.1.454.CMB.1.raw
tcagtacagatcgtcacgaccggtgctcgatttagcgagacgcgcaggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccatctcctcgcaacgtcggaaccagctagtacgtcggttgggtaggttaataacttagtcgttctccgtcggtaaccaactacccaccacggacaaaccgaccccaaactcgaattagtattttatagtacttcgtactaaggttaaacgtccggtaccccgttacgttaacggggtttaacttacgtacgttccgtttacgttaccgtccggtaccttaccgttaacggtccggttacggtaaaccgtaaccggtaacccgggtcccctttaccctacccggttaaacccgttcgttacccgttacgggttccggggtacccgtcccgtaaaccgggtctaaccgggtaaccgggacggaacggtcgttaacggttactttacttacgttcgactcgtaccgtatactaacgtaaacacggtactacggactaccgtaccgtaccttaccggtcggttacgggtacggggtaaccggaccgggtaacgtacggtaaccggtaccggtaacccggttccggtaacggccgttaacccggacccggtaaccggtaccgtcccccggttacccccggttgtaaccccg

SEQ ID NO: 279463 - DNA, 836 bp, Homo sapiens
  misc_feature: GYAE6OF02GJMXS.35.9.A09.1.454.CMB.1.raw
  modified_base (198)..(198): a, c, t, g, unknown or other
  misc_feature (198)..(198): n is a, c, g, or t
tcagtacagatcgtcacgaccggtgctcgatttagcgagacgcgcgagggggggggtctcgaggaggcagcgctctcggggacgtctccaccatggcctgggctctgctattccctcaccctcctcactcagggcacagggtcctgggcccagtctgccctgactcagcctgccctcgtgtcgtgggtctcctggacngtcgatccacatcctcctgcctacgtggaaccagcctaggtgtaccggtttggtaggttaataactgtgtccttccgtcggtaccaaccacccacccgaggaccaaaccgccccctaaacttacgttaatttagaaggaccaactaacgaccgaccctcgaagggtactttaccaagtccgtactttcctgtacgcctaccaacgttctacggactaaccgtccgggtcccctaccgtacgaactaacttccgtacggttccgggtaccgtcccgggtacgttacgggaaacgggtacggacggttcggtagttacgttttaagttacgtttacggtcgtacttaccgtaatttacggtcgtaggtaacggttaaggtacgtaaccttaacgttaacggtttaccggttaccggttttaaccgggaaacgggtttacccgggggaaaaccggttaaaccgggttaccccggtaacccgggtttaccggttaacccggtaccggtaaccccggtaaccccggttaaacccggggaaaccccctaaacccccggacggttttaacccgttaccccggtaaacccttttccccgggttacccgtttacccccccggttaccccctaccggtttaacccccg

SEQ ID NO: 279464 - DNA, 660 bp, Homo sapiens
  misc_feature: GYAE6OF02F9RJ3.35.9.A09.1.454.CMB.1.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
tcagtacagatcgtcacgaccggtgctcgatttagcgagacgcgcgaggggggggggtctcaggaggcagcgctctcgggacgtctccaccatggcctgggctctgctattcctcaccctcctcactcagggcacgtagggtcctgggcccagtctgccctgactcagcctgcctcgtgtcgtgggtctctggacagtcgatcaccatctcctgcatggaaccagcagtgacgttggtgttaanactagtntctccgtggtaccaacaccaccaggacaaacgtcccccaaatcaactgtaactttataggatgtactaagtaacgtaccggcctcggtaaggggttttactaaagtccggtactttccgtacgtcggtactaccgtaaacgttcgtagggaactaacgaccggtacctcctacgacctactccgtcgtcgggtcctaccggagtaccgtacggaaccggaacggtggtacttaggtaattttacgtaacgttcggacttacgactaacgtataacgtaagaacgacacgacgtacactaccgttacgttcgtcgggttaccgggacggtacgggtacaacggtacgtccggtaccgtaacgtacggtacctacggacccgaaggtcccaccggttacccctgtaccccg

SEQ ID NO: 279465 - DNA, 732 bp, Homo sapiens
  misc_feature: GYAE6OF02HIVJJ.35.9.A09.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
tcagtacagatcgtcacgaccggtgctcgatttagcgagacgcgcaggggggggggtctcaggaggcagcgctctcgggacgtctccaccatggcctgggctctgctattcctcaccctcctcactcagggcacgagggtcctgggcccagtctcgccctgacctcacgcctgcctcgtgtctgggtcctctggacngtcatcaccatctcctgcactggaaccngcagtgacgttggnctagaactaactatcgtctccgtacggtaccaacaccaccgacgaccaaccgaccccaaatcatagtacttagtacgtatacgtactaacgtacgtccggtaccgttacgtacgggtttctaacgttccgtcgttctcgtcgtcctacgtagtcgtacgaccgtaacgtcccggtaccctcccgtacgtaaccctcgttaccgtccggtacggtcccgtaccggtacggtaccgtacggaccggtaacgggtacggtaccgttagttaacgtttacgttaccgacgttacacgttacctactaaacgttaacctaaccgaacacgtaaccgacgttaaccgttccttccggttacgggttaccgggttaccgggggaccggtacgggtaacccgtacggtaccgttacccggttacccggttaaccggtacggtacccggtaacccggtacccgggtaaccgtaccggtttcccccggaccccgtttacccgg

SEQ ID NO: 279466 - DNA, 670 bp, Homo sapiens
  misc_feature: GYAE6OF02IRDWP.35.9.A09.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
tcagtacagatcgtcacgaccggtgctcgatttagcgagacgcgcaggggggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacngtcgatcacatctcctgcactcggaaccngcagtcgacgttggtggttataactatcgtctcctgtaccaacaccaccgaggaccaaacgacccccaaactcatagtatttatgtatgtacatacgtccgtcctgttagggtttctaatcgtcttctcgtcgtcctactagtctcgacaacgacgtcctacctacacctcttccgtcgtacgggtcctaccggacggtccgtacggaaccggtacggacggaccgttagtaactttaacgttactcgtactacgtccctaacgtaattaacctaaaccgtaacctaacggacctaacgacctaaccgttcgttaccgggttaccggttccgggtaaccggggaccgggtaccgaacggtccggttaacccgtaccggttacgtaaccggtaccgacccgtaccgaccggtacccgtccccgggtacccccgtttcggacccttacccg

SEQ ID NO: 279467 - DNA, 703 bp, Homo sapiens
  misc_feature: GYAE6OF02GO63V.35.9.A09.1.454.CMB.1.raw
  modified_base (384)..(384): a, c, t, g, unknown or other
  misc_feature (384)..(384): n is a, c, g, or t
  modified_base (519)..(519): a, c, t, g, unknown or other
  misc_feature (519)..(519): n is a, c, g, or t
  modified_base (544)..(544): a, c, t, g, unknown or other
  misc_feature (544)..(544): n is a, c, g, or t
tcagtacagatcgtcacgaccggtgctcgatttagcgagacgcgcgaggggggggggtctcagggaggcagcgctctcgggacgtctccaccatggcctgggctctgctattcctccaccctcctcactcgagggcacgacgggtcctgggcccagtctcgacccgtgacctcacgcctgcctccgtgtcgtcgggtcctcgtacggacacgtcgactccaactacgtcctaccgtcgacaccgtacggaaacctgactacggtgtacggttacgtcggacgtacgtagttaactcgttaggtcccttaccggtacgtaacccgaaccacccgtaaccgaacggaccaaacccgtaccccgaaaactcaacgtagtacgtttanacgtagttacgtacgagttaccgccggttacctacgggttacggtactacggtctacttcgtcctaagtcctacgtactcgtacgaccgtaccgaccgtcctacctacgtacctacgtccgttacggccggtacncggtacgcgtacgacggtcggtacncgtataacgttcgtactcggactgtacctagacgttaccgaactaccgtgaaccgacctacgtccggtacgtccggttaacgacccgggtcggtaacgaccgtcgtccgtacggtccgtacgtacgacgtccgaccgttcgacccgtccggtcccgtac

SEQ ID NO: 279468 - DNA, 737 bp, Homo sapiens
  misc_feature: GYAE6OF02JAVYD.35.9.A09.1.454.CMB.1.raw
  modified_base (196)..(196): a, c, t, g, unknown or other
  misc_feature (196)..(196): n is a, c, g, or t
tcagtacagatcgtcacgaccggtgctcgatttagcgagacgcgcaggggggggggtctcaggaggcagcgctctcgggacgtctccaccatggcctgggctctgctattcctcaccctcctcactcagggcacagggtcctgggcccagtctcgccctagactcagcctgccctcgtgtctgggtctactggacngtcgactcaaccatcctacctggcacgtaggaaccagtcagtcgacgttggtagttataactatgtctctgtaccaacaccaccaggacaacgacccaactacactatattatgtatcgtactagtacgtcgtcctacgtagggttctaagtcgtactctacgtcgtctacgtacgtctacggacaacgacgtcctccgtacgtaccgactccgtacgtcgggacctaccgtacggtacttacggaacgtaaccggtacggtacgtaacggtaactttaacgttaaccgtacgtacgtacggtaaccttaccgtaaataaccgtaaacgtaaccggtaccgtaacggaccgtaaccggtacccgtaccggttaaccgttacccggggttaacggtaccggggtaaccggggtaccggtaaccggtaaaccggttaccggttacccggtaaccgggttaccccgtttaaaccggtcccgaaccggtacccggtaaaccggtccccggtaccccggttacccccgttacccgggttaaccccg

SEQ ID NO: 279469 - DNA, 679 bp, Homo sapiens
  misc_feature: GYAE6OF02F8S7S.35.9.A09.1.454.CMB.1.raw
  modified_base (303)..(303): a, c, t, g, unknown or other
  misc_feature (303)..(303): n is a, c, g, or t
tcagtacagatcgtcacgaccggtgctcgatttagcgagacgcgcaggggggggggtctcagggagggcagcgctctcgggacgtctccaccatggcctgggctctgctattcctcgaccctcctcactcagggcacgagggtcctgggcccagtctggccctggactcagcctgacctccgtgtcctgggtcctcctggacagtcgatcgaccatctctgcactggaacctgcagtgatgtagggaattatgacttatgtctcctaggtaccaacttcaccagacacacgtaccccaaactnagatctaacaattcgacaaattacttccggacccttcgaaggtaacgtccctaaagttccgtttactacgtcgggtacctaccgaagttctacgggcttaacgtcgggaccgttccctaccggtccggaccctaattccgttccggcggggtaccttaccgaaggggtccctaggaaccgccgggtaaggcttaacggtatttaactacgtcgacacgtctaactaataacctacgaaaccacgtacaaacgtcctaaaccgttgtaccgttggttaccggggacggaacgggtaacaaccgggtcttaaaccgggtaccctaccggttaggtacccaacgggaccccgtaagggtcccctaccggttccccccgg

SEQ ID NO: 279470 - DNA, 124 bp, Homo sapiens
  misc_feature: GYAE6OF01CHI5H.52.3.A03.1.454.CMB.1.raw
  modified_base (124)..(124): a, c, t, g, unknown or other
  misc_feature (124)..(124): n is a, c, g, or t
tcagcgcagtacgacacgaccggtgctcgatttagagagcgtcacaggggcacagcggccctgggctgcctggtcaaggactacttcctcgtactgcgctgagcgggctggcaaggcgcatagn

SEQ ID NO: 279471 - DNA, 126 bp, Homo sapiens
  misc_feature: GYAE6OF02GVUVT.52.3.A03.1.454.CMB.1.raw
  modified_base (124)..(126): a, c, t, g, unknown or other
  misc_feature (124)..(126): n is a, c, g, or t
tcagcgcagtacgacacgaccggtgctcgatttagagagcgtcacaggggcacagcggccctgggctgcctggtcaaggactacttcctatacgatcgctgagcgggctggcaaggcgcatagnnn

SEQ ID NO: 279472 - DNA, 131 bp, Homo sapiens
  misc_feature: GYAE6OF01EFZVD.23.28.C06.1.454.CMB.1.raw
  modified_base (130)..(131): a, c, t, g, unknown or other
  misc_feature (130)..(131): n is a, c, g, or t
tcagacgcgagtatcacgaccggtgctcgatttagagctcacgtattgggtttgggcacagcggccctgggctgcctggtcaaggactacttccatactcgcgtctgagcgggctggcaaggcgcatagnn

SEQ ID NO: 279473 - DNA, 574 bp, Homo sapiens
  misc_feature: GYAE6OF01C3C6X.23.28.C06.1.454.CMB.1.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagacgcgagtatcacgaccggtgctcgatttagagctcacgtattgggtttgggggtgggtccaggaggcagaactctgggtgtctctccatggcctggatccctctacttcttccctcctcactctctgcacagaatctgaggccgcctatgagttgacacagactccttcggtgtcagtgtccccggganacacggccaggatcacctgctctggagatgcattgccaaagctaatttgcttatggtatcagaagaagccaggtcagccctnttctccttanctacagacnctgagacgcctnagggatacctgttcgcttntctggtcctaccaggtttcaagggtacaaacaggtccatattacggatccaattcgaaggtcggacggtaccagggaccaggtaaagacggaaggctacgtacttacgttttgtcagtacagtcagacgtaggtacgggaggtcgacggaccgaacggtctaccggcccctacgggtccaccgttctccggttaccccaccttccctcgacttaccgtcgtccgtactcggacgccgggtcgtacggg

SEQ ID NO: 279474 - DNA, 607 bp, Homo sapiens
  misc_feature: GYAE6OF01A9QME.23.28.C06.1.454.CMB.1.raw
  modified_base (366)..(366): a, c, t, g, unknown or other
  misc_feature (366)..(366): n is a, c, g, or t
tcagacgcgagtatcacgaccggtgctcgatttagagctcacgtattgggtttgggggtgggtccaggaggcagaactctgggtgtctctccatggcctggatccctctctggctcactctcctcactctttgcataggttctgtggtttcttctgagctgactcaggaccctgctgtgtctgtggccttgggacagacagtcaggatcacatgccaaggagacagcctcagaagctattatgcaagttggtaccagcagaagccaggacacggccccagcacttgtctatttatagaataaaaataggtccggccctacgagggactccccgaagaccgtattctctggcctccagttcgagganacacagcttcctagaccatcacgtcggggctcgaggacggaagagtggaggctagtacttatttctagtaacccgtcccgggacaaccgtaggtcggtacgacgtagttacgttaagtttacgggtagttcgggacgggtaacgggaacctaaggtccgtacgggtaccccgttaccgtaaacggttccgaacggtaccccgtaaacgggcccttacccgggtccccccgttcggtacccg

SEQ ID NO: 279475 - DNA, 659 bp, Homo sapiens
  misc_feature: GYAE6OF01AG0UK.23.28.C06.1.454.CMB.1.raw
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtcgtccccgggacacgacggccaggatcacctgctcgtggagatgctattgaccaaagctaattttgtactttagttaggtatacgaagaaaggaacgccgaggtccacggtccccttcttcctccttatcctaacgaaggacacgtgagacggccctacgagggtactaccgttggttccgtctttctcgttcggtcctccgtacgttcgaacgggaaccaacgtacgtcaacgtagttggaacgtctaacgtcgaggtcggtacgtaccgacggacgaaggaacggaacggacggacgttagtaacgtttacgtttacgtcgacgtacgacgacgaagtacgaggtaggtacggtacgaccgacccgaacggtccgtcccgtccccgtcggtcctaccgttccgttcccggttccccgtccccttccctccgtaccttccgtccgtccgttcgtaggcggtccgggtcgtcggg

SEQ ID NO: 279476 - DNA, 861 bp, Homo sapiens
  misc_feature: GYAE6OF01DRJIY.23.28.C06.1.454.CMB.1.raw
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtgtccccgggacacacggccaggatcacctgctctggagatgcattcgaccaaagctaatttgcttattggtatcaagaagaagccaggtcacggtcccctcttcctccttatactaacaacggacactgacgacggccctgagggacttacctgttccgctttcgtcctcggtcctaccgtagttaccgaggggtaaaccaaacgtagtaccaacgtagtttcgaaggacctaagttccgtaacgggtacgggtaacgttacccggaacgggtaccgaaaacggggtaaacgggaaccgggaaggggtacctttacggttaaccgttttaaccgtttttttcgggtacgttaacgttcccgtaacgggaccgtaaacgggtaaccggttaaacgggggttcgggtaaacggggtttacccgaacgggtaccccccggtaaaacggggttccccggtttaccccggacccccccccgggttttacccggggttaccccgttaaacccggtttccccccgttttacccgggtttacccccccccttaaccccccggttttaccccctttaaccccgtaaccccgttttaaccccggttacccccgggtttccccggttacccgggttaccgggtaaccccgggggttccccggggggttcccggttaaaccccgggggg

SEQ ID NO: 279477 - DNA, 724 bp, Homo sapiens
  misc_feature: GYAE6OF01EPRV5.23.28.C06.1.454.CMB.1.raw
  modified_base (236)..(236): a, c, t, g, unknown or other
  misc_feature (236)..(236): n is a, c, g, or t
tcagacgcgagtatcacgaccggtgctcgatttagagctcacgtattgggtttgggggtgggtccaggaggcagaactctgggtgtctctccatggcctggatccctctctggctcactctcctcactctttgcataggttctgtggtttcttctgagctgactcaggcctgctgtgtctgtggccttgggacagacagtcgaggactcacatcgaccgaaaggagacacgccctnaagaagtctattatgactaaggttcggtaaccagcaagaacgccgaaggaccgacggaccccagcctacgttgtacttaagtttatagtaaaattaaaaacgtcggtaccgaccctacggaacgggtacctacccgaacggtaccgtacgttccgtacgtcggtacctaccgtacggttaccgaaggaactaccgacgtacgtcccgtttaccgtacgaacctactaccggacggtcggggtacctacgggtaagggacggaacggtagtacggacggtacgttacgtaacttttacgtttaccgtaacggttaacccgtacccgggaaacgtaacgtaggggttcgtacgtaacgtactttaacggtttaaggtttagggtacgttccgggacggtaaccggactaacggtccgttacggaacccggttcgtaacgtaccgaaccgtacccgtaacggttcccgtacccggtcccccgtcggtaccc

SEQ ID NO: 279478 - DNA, 758 bp, Homo sapiens
  misc_feature: GYAE6OF01B9WLJ.23.28.C06.1.454.CMB.1.raw
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagacttccttcggtgtcagtcgtccccgggacacgacggccaggactccacctgctcgtgggagatgctagttcgaccaaagtctaatttgactttagttggtatacgaagaagaacgccgaggtccaccggtccccttctttccttacccttataccgtaacgaaacggacctacgtaggaacggaccggtaccccgtacggaacgggtaactttacccgttcggtttccgtcctttacgtccgtcgggtcccttaccgtaaggtttaccgaacggggtaacctaacgtacggttacaacgttagtttacggacgtactaacgtacggtagggtacggacgttaccggaacgggacgaacgggaaacggacggtacgggtcttacggttaccgtttaacgttttaggaccgtacggtacgtacggacgtaacggtaacgtagggtacgggtacggtaccgacgtacccggacggtccgtacccgccccggttaccgtaccgtccgttaccgttcccgttcccccgtccccttaccgtccgtaccgttaccgtcccggtccgttcgtacgggccgggtccgggtcgtaccggg

SEQ ID NO: 279479 - DNA, 708 bp, Homo sapiens
  misc_feature: GYAE6OF01CR0M8.23.28.C06.1.454.CMB.1.raw
  modified_base (201)..(201): a, c, t, g, unknown or other
  misc_feature (201)..(201): n is a, c, g, or t
tcagacgcgagtatcacgaccggtgctcgatttagagctcacgtattggggtttgggggtggggtccaggaggcagaactctgggtgtctctccatggcctggatccctctacttccttccctcctcactctctgcacagaatctgaggccgcctatgagttgacacgagactccgttcggtgtcaggtcgtccccggganacgacggccagggactcgacctgctcgtggagtatgactattcgaccaaagtctaatttcgactttaagtggtatacgaagaagaacgacgaggtccacggtccccttgttccttaccgttacttcctaacggaacggaacctacgtaggtacggaaccggtccctacgacggggtaacttaacccgttgttaccggtctttccgtcgttcggtccttaccgaacgttacgaacggggaacaaacgtgtactaacttagtggaacgcacttcgaggtacggacgtaccgacggacaaaggaacgacggacggactagtacgttacgttttgacgtagtacgagtacgaacgtacgaaggtacggacggtacgaacgaccgaaggtcccgtaccggtaccccggttcgtacctaccggttccgttaccggtcccctaccccgttccgtaccttaccgtccgtacccgtaccggttcgtaacggtccgggtccgggtccgtaaccgggg

SEQ ID NO: 279480 - DNA, 943 bp, Homo sapiens
  misc_feature: GYAE6OF01DL5Q1.23.28.C06.1.454.CMB.1.raw
  modified_base (139)..(139): a, c, t, g, unknown or other
  misc_feature (139)..(139): n is a, c, g, or t
  modified_base (243)..(243): a, c, t, g, unknown or other
  misc_feature (243)..(243): n is a, c, g, or t
tcagacgcgagtatcacgaccggtgctcgatttagagctcacgtattgggtttggggggtgggtccaggaggcagaactctgggtgtctctccatggcctggactccctctacttccttcccctcctcactctctgcanagaatctgaggccgcctatgagttgacacacgtaccttccgttcggtgtcgaggtccggtcccccgggacacgaccggccaaggactccgaccgtgccttacgngggagattgaccgtattacgaacccgtaaaagtcttaaagtttcgtacttttaaggttgggttaactacggaaaaggaacggtaaccggtaccggtaacgggtttaccgtaacccgggttttcccccttccttttaccttaccccgttttaacgttaacccggtaaaaccggtaaacgggtaccgtaacgggttaccggaaacgggtaacccggtaccccgttaacggtaacgggttaacctttacccgttggtttacccgtaccttttccggtcgtccggtaccctacggtaacgttacccgaaagggtaaccaaaccgttcgtaacctaacgttgtttaacgaacgtacgtaaagttaccggtaggtacgggtacctaaccgggaacggaaccgtaaacggggtaaaacgggtaccgggtaacgggttacccttaacgggtttaccttttaaggtttaccggtaccgtaacggttaccgtacgaagtaaccgggtaacgttaacgggtacgggtaccggtaaccgggtaaccggaacccggtaacggttccccggtacccggtcccccgggttaccgtaccgttaccccggttcccgtttacccccggttccccgtaacccccgttcttaaccgacccgttacggttccccggtacggtacccggtagggtaacccgggtcgggtcccgggtaacggg

SEQ ID NO: 279481 - DNA, 790 bp, Homo sapiens
  misc_feature: GYAE6OF01DAO44.23.28.C06.1.454.CMB.1.raw
  modified_base (184)..(184): a, c, t, g, unknown or other
  misc_feature (184)..(184): n is a, c, g, or t
  modified_base (204)..(204): a, c, t, g, unknown or other
  misc_feature (204)..(204): n is a, c, g, or t
  modified_base (582)..(582): a, c, t, g, unknown or other
  misc_feature (582)..(582): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatcgtgaggccgcctatgtagttgacacagtacctccgttcggtntcaggtccggtccccggganaccgaccggccaggctaccacctcgcctcgtaggagtatcgactagttcgaacctaaagcttaatttgtacttttagtgttatacgaagaacgaacgtccgacggtaccgaccggtccccttcttaccgtcccttataccgtaacgaaacggtacctacgtggaacgaccggtaccccgtaggacggtaaccttaccgtcgttacccgtctttccgtcgtcgtcctaccgttacgttacgaacggtaaccaagtacgtacctagtacgttcgaacgtactacgtacgtagggtcggaccgtaccggaacggagtaaacggaacgacggtacggtaccgttacgtttaccgtttaccgtttacgtacgtaccggttaanaccgtacgtaacgtaacggtacgggtaacgggtacggttaccgaaccggtaaccccgggtacggtccccgttacccggttacccccggtccgggttccctacccggtttcccggttaccccgtttcccccgtacccttaccccgttaccgttacccgttaccgttcccggtacccgttcgtacgggccggggtccgtcgggtaaccgg

SEQ ID NO: 279482 - DNA, 770 bp, Homo sapiens
  misc_feature: GYAE6OF01CK013.23.28.C06.1.454.CMB.1.raw
  modified_base (154)..(154): a, c, t, g, unknown or other
  misc_feature (154)..(154): n is a, c, g, or t
  modified_base (260)..(260): a, c, t, g, unknown or other
  misc_feature (260)..(260): n is a, c, g, or t
  modified_base (520)..(520): a, c, t, g, unknown or other
  misc_feature (520)..(520): n is a, c, g, or t
tcagacgcgagtatcacgaccggtgctcgatttagagctcacgtattggggtttgggggtgggtccaggaggcagaactctggggtgtctctccatggcctggactccctctacttcttcccctctcactctctgcacagaatcgtgacggccnctatggtagtgaacacgacgtacttccgttcggtcgtctacggtccggtaccccggggaacacgaccgggacgtaaggactccgacctcggccttcggagggtaanagtcggtactagttaccgaaccgtaaaacgtacgtttaagtttcgtaacttttaggttaggtaactaagaaacggtaaaacggacgacccggtacgggttaacccacccggtttccccttcctttaccgttaccttaacgtaacgttaaccgaaacggtaactacggtagggtacgaccggtaccgtaggacgttactccgtgtcctagtctgtccggtactaccggtacgtacggaacgactacgtacactatgtaacncgtataagtcggagtacggacgtacgacgaacggtaacggaacgacggtaggtacgtacgtttaccgtttacgttacgtacgtaacgtacgaacgtacggtacgtacggacgggttacgggaacgaccggacgtaccgggacgtcccggtacccggtacccggtacgttcctaccgtcccgttacccgtccgtaccctacggttactccggtacgtccgttaggacggtacggcgggtcggcggtacggg

SEQ ID NO: 279483 - DNA, 498 bp, Homo sapiens
  misc_feature: GYAE6OF02I2XDJ.23.28.C06.1.454.CMB.1.raw
  modified_base (279)..(279): a, c, t, g, unknown or other
  misc_feature (279)..(279): n is a, c, g, or t
  modified_base (485)..(485): a, c, t, g, unknown or other
  misc_feature (485)..(485): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtgtccccgggacacacggccaggatcacctgctctggagatgcattgccaaagcaatttgcttattggtatcagaagaagccaggtcaggcccctnttctccttatctacaaggacactgagaggccctcagggatacctgttcgcttctctggctccagtttcagggacaacagtcacattgagcatcagtggagtcaggcagaagacgagctgactactttgcagtcagcagacagtggagtcagccaaggctcgcccctggtccactctcgttcccgtccctcctcactactcgcgtcngacgcgggctcgg

SEQ ID NO: 279484 - DNA, 521 bp, Homo sapiens
  misc_feature: GYAE6OF02I7GSD.23.28.C06.1.454.CMB.1.raw
  modified_base (447)..(447): a, c, t, g, unknown or other
  misc_feature (447)..(447): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtgtccccgggacacacggccaggatcacctgctctggagatgcattgccaaagcaattgcttattggtatcagaagaagccaggtcaggcccctcttctccttatctacaaggacactgagaggcctcgagggatacctgttcgctttctctggctccagtttcagggacaacgagtcacattgagcatcagtggagtccaggcagaagacgaggctgactacttttgtctagtcagcagacagtggagtcagacccaaggccncgcccccgtggtccacctcgtccgttccccgcccttcctcctactacctcgccgttcgtggacgcgggctcggg

SEQ ID NO: 279485 - DNA, 517 bp, Homo sapiens
  misc_feature: GYAE6OF02F39U8.23.28.C06.1.454.CMB.1.raw
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtgtccccgggacacacggccaggatcacctgctctggagatgcattgccaaagcaatttgcttattggtatcagaagaagccaggtcaggcccctcttctccttatctacaaggacactgagaggccctcagggatacctgttcgcttctctggctccagttcagggacaacagtcacattgagcatcagtggagtccaggcagaagacgaggctgacttactttgcagtcagcagacagtaggaggtcagcccaaggctacggccccctcgggtccacgtcctcgtttccccgccctccctcacttacctcgcgttcctgacgtcgggctcgg

SEQ ID NO: 279486 - DNA, 543 bp, Homo sapiens
  misc_feature: GYAE6OF02GX60Q.23.28.C06.1.454.CMB.1.raw
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtgtccccgggacacacggccaggatcacctgctctggagatgcattgaccaaagcaatttgctttattggtatcagaagaagccaggtcaggcccctcttctccttatctaacaaggacactgagacgccctgagggactacctgttcgtcttctctcggctccagttcgagggaacaacagtaccactattgagcatcgagtggacgtcgaggcagaagacgaggctgacttacgttttgactagtcagcagacaggtagggtacgtcgacgacccgaaggcctccgccccgtgtcctacgtcgtccgtccccgtccctcctctacctcttccgccgttcgtcgacggtcggcgtcggg

SEQ ID NO: 279487 - DNA, 532 bp, Homo sapiens
  misc_feature: GYAE6OF02IP8R7.23.28.C06.1.454.CMB.1.raw
  modified_base (285)..(285): a, c, t, g, unknown or other
  misc_feature (285)..(285): n is a, c, g, or t
  modified_base (437)..(437): a, c, t, g, unknown or other
  misc_feature (437)..(437): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
  modified_base (517)..(517): a, c, t, g, unknown or other
  misc_feature (517)..(517): n is a, c, g, or t
  modified_base (528)..(528): a, c, t, g, unknown or other
  misc_feature (528)..(528): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtcgtccccgggacacacggccaggatcacctgctctggagatgcattgaccaaagctaatttgctttattggtatcaagaagaagccaggtcacggcccctnttctcctttatctacaaggacactgagacggccctcgagggataccgtgttccgctttctctggcttccagttcagggacaacgagtcacattgagcatcagtggacgtcgaggacaggaagacgaggctgtacttactttgtacagtcagnaggacaggtggaggtcacgccgaagcctcgccccgtcgtcncctcttccgtcccnccctctcctactccgtcgcgttccnggacggcggtntcgg

SEQ ID NO: 279488 - DNA, 549 bp, Homo sapiens
  misc_feature: GYAE6OF02F0Y9O.23.28.C06.1.454.CMB.1.raw
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtcgtccccgggacacacggccaggatcacctgctcgtggagatgcattcgaccaaagctaatttgctttagtgtatcagaagaagccaggtcaggcccctcttctccttatctacaacggacactgagacggccctcgagggatactgttcgcttctctggctcngttcgaggacaacagtcanattgagcatcagtggacgtcgaggcagaagacgaggctgtacttacttttgctagtcagcagacgagtggaggtcacgcccgaagccgtaccgtccccgtcggtcctaccttccgtacggtttcccccgcccttccctcctactaccgtccgtccgtcgtcggacggtccgggcgtaccggg

SEQ ID NO: 279489 - DNA, 685 bp, Homo sapiens
  misc_feature: GYAE6OF02IVYG7.23.28.C06.1.454.CMB.1.raw
  modified_base (196)..(196): a, c, t, g, unknown or other
  misc_feature (196)..(196): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtcgtccccggganacacggccaggatcacctgctcgtggagatgcattgaccaaagctaatttgacttattggtatcagaagagccgaggtcacggccccttgttctccttatctaacaaggcacgtgacgacgccctgagggactaccgtgttcgctttcgtcgtcggtcctccgtaggtttaccgagggtaccaaacgtacggtaccaactagtttcggaacgtcctaagttccgaaggtcgggtaacgtccgaagggtacaaagggaaacggacggaaggtcgtaggtaacctttaacgtttttcggacctaggtccaagtacaaggacgtaaggtacgggacggtacaaccggtacccgaagggtacccgtccgtcccccgggttacgttcccgtaccgttccgtttcccggtacccccgttcccccttcgtacccgtaaccgttcccggtaccgttccggttccgtacgggtaccgggtccgggtccgtaaccgggg

SEQ ID NO: 279490 - DNA, 565 bp, Homo sapiens
  misc_feature: GYAE6OF02ID2GS.23.28.C06.1.454.CMB.1.raw
  modified_base (284)..(284): a, c, t, g, unknown or other
  misc_feature (284)..(284): n is a, c, g, or t
  modified_base (557)..(557): a, c, t, g, unknown or other
  misc_feature (557)..(557): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgcctatgagttgacacagactccttcggtgtcagtcgtccccgggacacacggccaggatcacctgctctggagatgcattgaccaaaagctaatttgctttattggtatcagaagaagccaggtcaggcccctnttctccttatctacaaggacactgagcggccctgaggtactaccgtgttcgcttctcgtggctcctgttcgaggacacacgtcactattgagcatcagtggacgtccgaggacaaggaagacggaggctagtacttacgttttgacgagtcagcaagacgaggtaggagtacgacgaccgaagcctaccggccccgtcggtccaccgttccgttccgttccccgcccttccctcctaccttaccgtccgtccgttaccgtcggacggtccggngtaccggg

SEQ ID NO: 279491 - DNA, 627 bp, Homo sapiens
  misc_feature: GYAE6OF02JMH0O.23.28.C06.1.454.CMB.1.raw
tcagacgcgagtatcacgaccggtgctcgatttagagctcacgtattgggtttgggggtgggtccaggaggcagaactctgggtgtctctccatggcctggatccctctacttcttccctcctcactctctgcacagaatctgaggccgcctatgagttgacacagactccttcggtgtcagtgtccccgggacacacggccaggatcacctgctctggagatgcattgccaaagcaatttgcttattggtatcaagaagaagccaggtcacggcccctcgttcctcctttatcctacgaaaggaccacgtgagacggcccctacgaggggtaacttacccgttgttccgtcctttccgtcttggcccttccgagtttcaggggaactaaacgacggtcaacagtttcgaagccaattcgaaggtggacgtaccgaggtcgaaggtaacgacggaaggtctagtacgttacttttgtacctacgttcgagacgagtacgaggttaggacgtcgacgacccgagggtcctaccggcccccttggtccctaccgtccgtccgttcccccgtacccttccgtacctacgttaaccgtccgtccgttccgtcggacggtccgggctacggg

SEQ ID NO: 279492 - DNA, 756 bp, Homo sapiens
  misc_feature: GYAE6OF02GLNA7.23.28.C06.1.454.CMB.1.raw
  modified_base (284)..(284): a, c, t, g, unknown or other
  misc_feature (284)..(284): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccgctatgagttgacacagactccttcggtgtcagtcgtccccggacacgacggccaggatcacctgctcgtggagatgctattcgaccaaagctaatttgcttagttggtatcagaagagccaggtcacggccctnttctcttatctacgaagacactgacgacggcctgaggtactaccgttgttcgtcttctctcggccttaccgtagttacgacgggaaccaacgtacgtacaactagttagaacgtctaagttacggtaacggtacgggtacggtaccggtaagggacggaaacggaaacgggaacgggtacggtaccggttacggtaacccgttttaacggtttttacggtacctaacggttacctacggaccgtaacgggtaaccgtagggttaccggggtacggtaccgtaaccgggaccccggtaaaggggtcccgttacccccggcccccgggtttcccgggttaacccgtacccgtttccccgtttacccgtttaaccccccctaccccgttaccccgttaacccgttacccgtttaacccggttccggttacccggttccggttaccgggtcggggtcccgggtcggttacccgggg

SEQ ID NO: 279493 - DNA, 516 bp, Homo sapiens
  misc_feature: GYAE6OF02FJ50C.23.28.C06.1.454.CMB.1.raw
  modified_base (130)..(130): a, c, t, g, unknown or other
  misc_feature (130)..(130): n is a, c, g, or t
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (434)..(434): a, c, t, g, unknown or other
  misc_feature (434)..(434): n is a, c, g, or t
  modified_base (511)..(511): a, c, t, g, unknown or other
  misc_feature (511)..(511): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactcnctgcacagaatctgaggccgcctatgagttgacacagactccttcggtgtcagtcgtcccccgggacacgacggccaggatccacctgctctggantgcattgccaaagctaatttgctttatggtatcagaagaagccaggtccaggccccctnttctccttatcctacaaggcactgagacggccctagagggtactacctgttccgctttctcgtcggctccagttcagggacaacngtcacnttgancatcagtgacgtcaggcagagacgaggctagacttatttgcagtcagcagacnggtggagtcacgcccgaggcctcgccctcgtcactctcgtcccgcctcgtcactaccgtcgcgtctggacggcggtntcggg

SEQ ID NO: 279494 - DNA, 638 bp, Homo sapiens
  misc_feature: GYAE6OF02G7KG3.23.28.C06.1.454.CMB.1.raw
  modified_base (150)..(150): a, c, t, g, unknown or other
  misc_feature (150)..(150): n is a, c, g, or t
  modified_base (226)..(226): a, c, t, g, unknown or other
  misc_feature (226)..(226): n is a, c, g, or t
  modified_base (410)..(410): a, c, t, g, unknown or other
  misc_feature (410)..(410): n is a, c, g, or t
tcagacgcgagtatcacgaccggtgctcgatttagagctcacgtattgggtttgggggtgggtccaggaggcagaactctgggtgtctctccatggcctggatccctctacttcttcccctcctcactctctgcacagaatctgaggccncctatgagttgacacagactccgttcggtgtcagtcgtccccgggacacacgggccaggatcacctgctcgtgganatgctattcgaccaaagctaatttgctttagttggtatcgaagaagacgccgaggtcgaccggtcccccttcttccttccttattacctaacgaacggacctacgtagacggaccgccctcggaggtactccttcgtctcttctctcgtcctcctgttacgaggaacacgagtcactattcganacactgtagtagacgtcgaaggcaaggacgaacggacgtacgtgtaaccgtttctttagtacgtacgtacaacgtcaacgacgtaggtagggtacgtaccgaaccggtaccgacgtcccgtcccgtaccccgtccgggtaccttaccgtccgttcccgtccccttaccctcccttacctaaccgttccgtaccgtcgttaccgcggacgggtccgggtacgtccgggg

SEQ ID NO: 279495 - DNA, 845 bp, Homo sapiens
  misc_feature: GYAE6OF02GZD37.23.28.C06.1.454.CMB.1.raw
  modified_base (236)..(236): a, c, t, g, unknown or other
  misc_feature (236)..(236): n is a, c, g, or t
tcagacgcgagtatcacgaccggtgctcgatttagagctcacgtattggggtttgggggtgggtccaggaggcagaactctggggtgtctctccatggcctggatccctctacttcttcccctcctcactctctgcacagaatctgaggccgcctatgagttgacacagactccgttcggtgtcaggttcggtcccccgggacacgaccggccaaggatcacctgctcgtgggaanagtcgctagttcgaaccaaagactagtttcgactttagttggttatacgaagaaaggaacggccgtaacggtaccgtaccgggtccccctttactttccttaccgttttaacgttaccgtaaccggaaacggtaacctacggttagggaacggtaccgggtaccccgtacgggaacggggttacctttaacccggttcggtttccggttaccttcccggtttaccgtccggggttaccctacccgttaagggtttacgggaaaccggaaccgtaacgttaaccgggtactaaacgtagttacggaacgtccgtaacgttacgaaggggttacgggtaaccggtacgggtaacggtaaccgaacggggaaaacggtcgggtaaacggttccgtaacgggtaaaccctttttcgtttaacgtaccgtaacgtcgtaacggacgtaacgtaacgggtagtacgggtaacgtcgaaccgggtccaaagggtcccggtacccgtacccggtcgttaccttaccggtccctttaccgggttccccccgcctttacccgaccgttaccgtaccgttcgacccgttggacccgggtaggtccgggttacaccggggg

SEQ ID NO: 279496 - DNA, 849 bp, Homo sapiens
  misc_feature: GYAE6OF02JWIRO.23.28.C06.1.454.CMB.1.raw
  modified_base (201)..(201): a, c, t, g, unknown or other
  misc_feature (201)..(201): n is a, c, g, or t
  modified_base (484)..(484): a, c, t, g, unknown or other
  misc_feature (484)..(484): n is a, c, g, or t
  modified_base (610)..(610): a, c, t, g, unknown or other
  misc_feature (610)..(610): n is a, c, g, or t
tcagacgcgagtatcacgaccggtgctcgatttagagctcacgtattgggtttgggggtgggtccaggaggcagaactctgggtgtctctccagtggcctggatccctcgtacttcttcccctcctcactctctgcacagatcctgaggccgcctaatgagttgacacagactccttcggtgtacaggtcgtccccggganacgaccggccaggatccaccttgaccttcgtgggacgatttcggcctagtttacggacccaaaaaggtccttaaagtttttcggaccttttaagttttcggggtaattccgaaggtaaggtaaacggccccgtaaggggtccccgtaaccggggtcccccctttaccttttccgttaccccgtttaactaccgttaaccgaacgggacctaaccgttcgaaaggtaccgggtcccccttagtaacgggggtactaacccggttggtttccctaccgtttaccncggttccgggaacccttccgtacgtttccgtaacggggaaccctaacgacggtttccaaccgtatttcgggaacaccctaagtccgtagtacggtaacgttccgacggcgaacggacggaacgggnggtacctaggtacttaaccgtttggttacctggtactacggtactacggactagggttagggacggtaccgaaccggtacccgtaaacgggcccgtaccggtccccccggttcgggtaaccctaccgttcccggttcccgggtttccccccgtaacccgtttccccgtaccttaacccgtacccgttccggttcccgtaacggttacccggaccggttccggggtcccgttaaccgggg

SEQ ID NO: 279497 - DNA, 543 bp, Homo sapiens
  misc_feature: GYAE6OF01B17D0.48.43.D10.1.454.CMB.1.raw
  modified_base (208)..(208): a, c, t, g, unknown or other
  misc_feature (208)..(208): n is a, c, g, or t
  modified_base (361)..(361): a, c, t, g, unknown or other
  misc_feature (361)..(361): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctgtgggagacagagtcacctnacttgccgggcaagtcaggccatttccaattctttagcctggtatcagcagaaaccaggacaaactcctacactcctgatctatgatgcgtcagtttagagagtgggcccagtcgagttcagcggcagtggatcgagggacagagttcactcnctacatcagcagcctgcagcctagaacgtattttgactaactttattactagtactaaactaactttaacaaacttaccctataacttaacgccgttacggaccaaacgggtacccaaggtacggaaacccaaggacgtaacgtcggtacggcttacggaccaacctatccgttggttaccc

SEQ ID NO: 279498 - DNA, 519 bp, Homo sapiens
  misc_feature: GYAE6OF01B5VXX.48.43.D10.1.454.CMB.1.raw
  modified_base (208)..(208): a, c, t, g, unknown or other
  misc_feature (208)..(208): n is a, c, g, or t
  modified_base (438)..(438): a, c, t, g, unknown or other
  misc_feature (438)..(438): n is a, c, g, or t
tcagagtatacatacacgaccggtgctcgatttagactagcagtaaggggcaggagtcagacccactcaggacacagcatggacatgagggtccccgctcagctcctggggcttctgctgctctggctcccaggtgccagatgtgacgtccagttgacccagtctccatccctccctgtctgcatctgtgggagacagagtcaccctnacttgccgggcaagtcaggccatttccaattctttagcctggtatcagcagaaaccaggacaaactcctacactcctgatctatgatgcgtccagtttagagagtgggccccatcgaggttcagcggcagtggatcagggacagagttcactctcaccatcagcagcctgcagcctagaagtattttgctaacttattactgtacaactaactttaacaacttaccctanaataacgccgttacggaccaacgggacccaaggtacggaaaaccaagacgaaacgtgtaggctaggacaccatctgttacc

SEQ ID NO: 279499 - DNA, 526 bp, Homo sapiens
  misc_feature: GYAE6OF01CLEXL.48.43.D10.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctnacttgccgggcaagtcaggccatttccaattctttagcctggtatcagcagaaccagacaaactcctacactcctgatctatgatgcgtccagtttagagagtggggcccagtcgaggttcagcggcagtgatcgagggacagagttcactctcaccatcagcagcctgcagcctagaagtatttgctaacttattactgtacaactactttaacaacttacctactactaacgtccgttacggcctaacgggaccctaagggtacggaaaccgaagaccggtaacgtggtacggctcgaccaccacttcgtgttacc

SEQ ID NO: 279500 - DNA, 529 bp, Homo sapiens
  misc_feature: GYAE6OF01B5Z9U.48.43.D10.1.454.CMB.1.raw
  modified_base (436)..(436): a, c, t, g, unknown or other
  misc_feature (436)..(436): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcgagggacagagttcactctcaccatcagcagccctgcagcctgaagtatttgactaacttattactgtcaactactttaacaatttacccntactaacgtccgttacggacccaagggaccctaagggtacggaaaccaagaccggtaaactggtacggctacgaccaccattccgtgttaccc

SEQ ID NO: 279501 - DNA, 573 bp, Homo sapiens
  misc_feature: GYAE6OF01EDZVD.48.43.D10.1.454.CMB.1.raw
  modified_base (208)..(208): a, c, t, g, unknown or other
  misc_feature (208)..(208): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctnacttgccgggcaagtcaggccatttccaattctttagcctggtatcagcagaaaccaggacaaactcctacactcctgatctatgatgcgtccagtttagagagtggggccccatcgaggttcagcggcagtggatcgagggacagagttcactctcaccatcagcagcctgcagcctgaagtattttcgctaactttattactgtacaactaactttaacaacttaccctactaattaacgccgtttacggacccgtaaacgggtaaccccgaagggttaccggaaaacccgaaagggaccgtaaaaccgtcgggtaacgggaccgttacggacccgtaaacccacgttcccgttggtttaccc

SEQ ID NO: 279502 - DNA, 532 bp, Homo sapiens
  misc_feature: GYAE6OF01C2QI9.48.43.D10.1.454.CMB.1.raw
  modified_base (452)..(452): a, c, t, g, unknown or other
  misc_feature (452)..(452): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
tcagagtatacatacacgaccggtgctcgatttagactagcagtaagggggcaggagtcagacccactcaggacaaagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctggtatcagcagaaccaggacaaactcctacactcctgatctatgatgctccagtttagagaggtcgggcccctagtcgtaggttcagcggcaggtgatcgaggacagtacgttcactctacacctatcagcacgcctgcagcctagaacttatttcgactaactttattactgtaccaaacttacctttaaacactttaaccctntaacgtaacgtcccgttacggaccaacgggtacccaggtacgaaaccagacgaacgtgcgcngacactanctgtntaccg

SEQ ID NO: 279503 - DNA, 646 bp, Homo sapiens
  misc_feature: GYAE6OF01D6BL3.48.43.D10.1.454.CMB.1.raw
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaagtcgggccagaggtgcccctgaacctgaaggccaatgagacccaagacaggccaagtggtgtgagacccctgaggagctgggccctggtcccaggcagcgctggccctgctgctgctgggtctggccagtcggtccgcccgacgttcgggcccttgccttcggccgccccgtaagttcgggttcgccgaaccggtccgaaacggccgggggaaccccacggaccccgtgggaccgtccgtacgacggttcggaacggtccgacggcccgaactcccgagcccgtaggccggacggtcccgtcgggtcggggccgtacggggtccaacggtccccgaaagggtcccgtacccgggtccccccgttacgggtaccctaaccgttcccgttccggtttaccccccccg

SEQ ID NO: 279504 - DNA, 572 bp, Homo sapiens
  misc_feature: GYAE6OF01ACV37.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttggccgggacaagtcaggcctatttccaatttctttagcctggtatcagcagaaccaggacaaactcctacactcctgatctatgatgcgtcctagtttagagagtcggggcccagtcgaggttcaggcggcaggtggatcgagggacagtagttcactctcaccatcagcacgcctgcagcctagtaagtattttcgactaactttatacttacgtactaactaactttaactaactttaccctactaacttaacgtacccgtttacggacccgtaacgggaccccgtaagggtaacggaaaaccgaaggaaccggtaacgtggtacggtctacggacccacctacttcgtcgtttaccc

SEQ ID NO: 279505 - DNA, 602 bp, Homo sapiens
  misc_feature: GYAE6OF01CDH4V.48.43.D10.1.454.CMB.1.raw
  modified_base (212)..(212): a, c, t, g, unknown or other
  misc_feature (212)..(212): n is a, c, g, or t
tcagagtatacatacacgaccggtgctcgatttagactagcagtaaggggcgagggagtcaggacccactcaggacacagcatggacatgaggtcccgctcagctcctcgggcttctgtctgctctggctcccaggtgccagatgtgacgtccagttgacccagtcctccgatcctccctgtcctgcatctgtggagacagagtcacccgtnacttgccgggtcaagtacaggtccattttccaattcttagcctggtatcagcagaaacccaggacaaacgtcctaacactcctgatcctatcgatgcgtccgagtttacgagagtggggcccctagtcgaggttcagcggcagtggatcgagggacagtagttcactctcgaccgtactcgagcaagcctagcagtcctagaacgttagttttacgactaacttattactagtactaacgtaactttaacaactttaacccgtactaacggttaacgtccggttaccgaccgtaacgggaacccctaagggtacggtaaaacccgaaggacccggtaaacgttcggtaacggtcccgtacggaccctaacctacttcgttccgttacccg

SEQ ID NO: 279506 - DNA, 545 bp, Homo sapiens
  misc_feature: GYAE6OF01A56A0.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggcaagtcaggccatttccaattctttagcctggtatcagcagaaaccaggacaaactcctacactcctgatctatgatgcgtccagtttagagagtcggggccccagtcgaggttcagcggcagtggatcgagggacagtagtcactctacacatcagcagcctgcagcctagaagtatttgactaacttattactgtacaactaactttaacaacttacctactaattaacgccgttacgaccgtaaacgggacccgtaaggtacggaaaacctaaggaccgtaaacgtcggtaggaccgtacgaccaaccctcgtcgtcgttaccg

SEQ ID NO: 279507 - DNA, 533 bp, Homo sapiens
  misc_feature: GYAE6OF01BKNZR.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccggcaagtcaggccatttccaattcttagcctggtatcagcagaaaccaggacaactcctacactcctgatctatgatgcgtccagtttagagagtgggccccagtcgaggttcagcggcagtgatcgaggacagagtcactctacaccatcagcagcctgcagcctgaagtatttgactaacttattactagtactaaactactttaacaattaccctactataacgtccgttacgaccgaaacgggtacccaaggtacggaaaccgtaagaccgtaaacgtcgtaggaccgttcggactacccattccgtgttaccg

SEQ ID NO: 279508 - DNA, 506 bp, Homo sapiens
  misc_feature: GYAE6OF01A37JL.48.43.D10.1.454.CMB.1.raw
  modified_base (500)..(500): a, c, t, g, unknown or other
  misc_feature (500)..(500): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtgggcccagtcgaggttcagcggcagtggatcgagggacagagttcactctcaccatcagcagcctgcagcctagaagtattttgactaacttattactgtacaactaactttaacaacttaccctacaataacgtccgttcgaccaacgggacccaggtacgaaaccagcgaactgtgctcgcaccntgtgtc

SEQ ID NO: 279509 - DNA, 658 bp, Homo sapiens
  misc_feature: GYAE6OF01C15KK.48.43.D10.1.454.CMB.1.raw
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggccctggtcccaggcagcgctggccctgctgctgctgggtctggccagtcggtcgcccgagtcggcctcgctgccgcccaagtcggttcgccgaccgaccgaaacggccggggaaccccgacggaccccgtacgggaccgcccgtcgaacggttcgggaaacgccgaaggacccgtagtcccaacggtcccgttcggccgggtaacggcccggttacgggtcggggggacccgtaaggggttcccgacgggacccccgaaacggggtcccgttccgggtccccccccgttacgggttccccgtaacccgttcccgttcccggtttaccccccccgg

SEQ ID NO: 279510 - DNA, 532 bp, Homo sapiens
  misc_feature: GYAE6OF01C5MVD.48.43.D10.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctnacttgccggnaagtcaggccatttccaattctttagcctggtatcagcagaaaccaggaacaaactcctacactcctgatctatgatgcgtccagtttagagagtggggccccagtcgaggttcagcggcagtggatcgagggacagagttcactctcaccatcagcagcctgcagcctgaagtatttgactaactttattactgttacaaactactttaacaacttacccactaactaacgtcccttacggacctaacgggaccccaaggtaacggaaaccaaggaccgaacgtgtacggctcgacaccactcgttgttaccg

SEQ ID NO: 279511 - DNA, 553 bp, Homo sapiens
  misc_feature: GYAE6OF01DGJW7.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccagtcgaggttcagcggcagtggatcgagggacagagttcactctcaccatcagcagcctgcagcctgaagtattttgactaacttattactgtacaaactactttaaacaacttaccctactaacttaacgcccgttacggacccaaaggggacccctaagggtacggtaaaacccaaggaccggaaacgttcggtaggaccttaggacccacctaacgtccttggttaccc

SEQ ID NO: 279512 - DNA, 529 bp, Homo sapiens
  misc_feature: GYAE6OF01BTT8Y.48.43.D10.1.454.CMB.1.raw
  modified_base (208)..(208): a, c, t, g, unknown or other
  misc_feature (208)..(208): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctnacttgccgggcaagtcaggccatttccaattcttagcctggtatcagcagaaccaggacaaactcctacactcctgatctatgatgcgtccagtttagagagtcgggcccagtcgagttcagcggcagtggatcgagggacagagttcactctacacatacacgcacgcctgcacgcctagaagtatttgactaacttattactagtactaactacttaactaacggttacctactactaacgtccgtacgaccgaacggacccgaacggtacggaaaccgaagacgaacgtacgtggacgtcgacaccactcgtcgttcc

SEQ ID NO: 279513 - DNA, 531 bp, Homo sapiens
  misc_feature: GYAE6OF01D50VL.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaccaggacaaactcctacactcctgatctatgatgcgtccagtttagagagtcggggcccagtcgaggttcagcggcagtggatcgagggacagagttcactctcaccatcagcagcctgcagcctgaagtattttgactaactttattactgtacaactaactttaaactaacttaccctataactaacgtccgttacggacccgtaacgggacccaagggtacggaaaacccaagaccgtaacgtggtggactgaccacactctgttcc

SEQ ID NO: 279514 - DNA, 542 bp, Homo sapiens
  misc_feature: GYAE6OF01AZUVK.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggcaagtcaggccatttccaattctttagcctggtatcagcagaaaccaggacaaactcctacactcctgatctatgatgcgtcctagtttagagagtcggggcccagtcgaggttcagcggcagtggatcgagggacagagttcactctcaccatcagcagcctgcagcctagaagtatttcgactaacttattactgtactaactaactttaacaacttaccctataacttaacgaccgtttacggaccgaaacgggtacccgaaggtacggaaaacccaaggaccgtaacgtaggtacggactacgaccactactctgttacc

SEQ ID NO: 279515 - DNA, 660 bp, Homo sapiens
  misc_feature: GYAE6OF01D7S63.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagacgtccaccctcacgttcggccgggacaagtcaggcctatttccaatttctttagcctggtatcagcaagaaccaggaacaactctacactctagatctatgatcgtcgtactagtttagagtacggtcgggacccctagtcggaggttcgaggcggacgtaggtggaatcggaagggtacaggtacgttcactctacaccatcacgactacgtcctacgactacgtaccgttagtaacgttagttttacgaacttaactttacttaactacgtaacttaaaccttaacctttaaacctaacctttaaccctacttaacgttaacccggtaccggttaacccggaaccgtaaccggggtaacccgtaagggtaaacccggaaaaccgtaacggtaccggtaaccgttacgggttaccggtaccgtacggaccctaacctacgttcccgttacggtttaccc

SEQ ID NO: 279516 - DNA, 542 bp, Homo sapiens
  misc_feature: GYAE6OF01BU940.48.43.D10.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (391)..(391): a, c, t, g, unknown or other
  misc_feature (391)..(391): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggnaagtcaggccatttccaattctttagcctggtatcagcagaaacaggacaaactcctacactcctgatcatgatgcgtcagtttagagtagtcgggcccatcgaggttcagcggcagtggatcgagggacagagttacacgtctcaacatcagcagctgacagcctgaagtntttgactaactttattactgtactaaactactttaacaattacccctatataacgccgttacggaccaaacgggtacccaaggtacggaaaacccgaagtaccgaaacgtgtacgggtacctacggacctaacccatcccgttgttacccg

SEQ ID NO: 279517 - DNA, 797 bp, Homo sapiens
  misc_feature: GYAE6OF01BTBDZ.48.43.D10.1.454.CMB.1.raw
tcagagtatacatacacgaccggtgctcgatttagactagcagtaagggggtcgtagggagtcagacccactcgaggacacagcatggacatgagggtccccgctcagctcctggggcttctgctgctctggctcccaggtgccagatgtgacgtccgagttggacccagtctccatcctccctgtctgccactctgtgggagacgacgagtccaccctcgacttcgccgggcaacgtcaggcctagtttaccaattcctttaagccttgggtatcagtcaagaaaccaggaacaaactcctaacactcctagactactaactgactacgtccgtacctaagtttacgaggtacggtaccgggacccctaagtccggtaacggttccgaacgggtcccggtacgtaagggtacggtacgttaccggaacgggggtaacctaacggttaacggtttccctaaccggttcccttaaccgtaacccgtaacgttacccgaaccggtaccccgtacgggtacccccgttaaggtcccgtaaacgggtccccgttaaggtaaacgttacgtttttacggaaccttaaacgttttactttacgtacgttaaccttaaaccgtttaaccttttaaacctaaccgttttaccccgtaacgttaaccgttaacgttccccggttaaccggaaacccggtaaccggggtacccgttaagggtaaccgggtaaaccgtaacgggtaccggtacgttcgggtaccgggtaacgtaccgaccgtaacccttcgttccgttcggttacccg

SEQ ID NO: 279518 - DNA, 678 bp, Homo sapiens
  misc_feature: GYAE6OF01C29U8.48.43.D10.1.454.CMB.1.raw
  modified_base (188)..(188): a, c, t, g, unknown or other
  misc_feature (188)..(188): n is a, c, g, or t
  modified_base (635)..(635): a, c, t, g, unknown or other
  misc_feature (635)..(635): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtcctccatccctcccttgtctgctntcgtgggaggacacagactacctacctactacgtcggccggaactacgtcgacgtacttacttactatttctacgccgttagtacacgacgacgaaaccgaaacgacgaaacctaacctaccacctaccttccgatacttactagtacgtagtccgtaccgtacgtttaaggttaggacggtacgggcccggtaccctagtaccggggtacggttcgaccggggtcgacgtagggttacgacgtacggggaacgtacgtaacggttccttacacccgttacaacccacgtaacgacgacgtaccgtaccgtccgtacgaccgtaccgtagtaagttaagtttcgtttacaactttaacgtttactacgttactaacctaactttaactaaactaccttacaatacgtaccgtcgtacgaacggtaaccgacgtaagaacccgaaacnggtactcggtaggtccacgtaccaccgtatcttgtcgttaccc

SEQ ID NO: 279519 - DNA, 574 bp, Homo sapiens
  misc_feature: GYAE6OF01BQQHX.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggcctatttccaattcttagcctggtatcagcaagaaccagacaactctacactctgatctatgatgcgtctagtttagagtacggtcgggcccagtcggaggttcagcggacaggtggatcgaagggacagacgttcactctacaccatacagcagcctgcacgccgtagaacgttatttcgactaactttacttactgtaactaactaactttaacgaactttaccctataacttaacgaccgtttaccggaccgtaaacgggacccgtaagggtaaccggtaaaaccgtaaggaccgtaaacgttcggtacggcctacggaccctaactacgttccgtggttaccc

SEQ ID NO: 279520 - DNA, 544 bp, Homo sapiens
  misc_feature: GYAE6OF01BZBCE.48.43.D10.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (516)..(516): a, c, t, g, unknown or other
  misc_feature (516)..(516): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgcctgcatctgtggganacagagtcaccctnacttgccggcaagtcaggccatttccaattcttagcctggtatcagcagaaaccaggacaactcctacactcctgatctatgatgctcagtttagagtaggtcgggccccagtcgaggttcagcggcaggtcggatcgaagggacaggtacgttcacttctaccaaccatacacgcaacgcctagacacgcctagaacgtattttgactaacttattactagtactaactaactttaacaacttaccctataactaacgccgttacggacctaacgggacccagggtaacgaaaccgaagacgtaacncgtacggctacgcaaccatcctgttacc

SEQ ID NO: 279521 - DNA, 560 bp, Homo sapiens
  misc_feature: GYAE6OF01DZSMZ.48.43.D10.1.454.CMB.1.raw
  modified_base (208)..(208): a, c, t, g, unknown or other
  misc_feature (208)..(208): n is a, c, g, or t
  modified_base (392)..(392): a, c, t, g, unknown or other
  misc_feature (392)..(392): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctnacttgccggcaagtcaggccatttccaattctttagcctggtatcagcagaaaccaggacaaactcctacactcctgatctatgatgcgtccagtttagagagtggggccccatcgaggttcaggcggcagtggatcgagggacagagttcactctcaccatcagcagcctgcagcctgaagtnttttgactaactttattactgtactaaactactttaacaactttacccctataacttaacggtcccgtttacggacccgtaaacgggaccccgtaagggtaaccggaaaaaccctaaggaccgtaaacgtcggtggaccgtcggaccacctaattccgttcgttaccc

SEQ ID NO: 279522 - DNA, 569 bp, Homo sapiens
  misc_feature: GYAE6OF01B2K7K.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctggtatcagcaagaaaccaggaacaaactcctacactctgatctatgatgctcagtttagagagtcgggcccatcggagttcagcggcagtggatcgaagggacagagttcactctcaccatcagcacgcctgcacgcctagaagtatttgactaactttattactagtactaacctaactttaaccaaactttaccctataacttaacggtcccgtacgggaccgaaacggggaccctaacgggtaacggaaaacccaagggaccgtaaaccgtcggttaggaccctacggaccctaaacccgtacttccgtcggtttaccc

SEQ ID NO: 279523 - DNA, 564 bp, Homo sapiens
  misc_feature: GYAE6OF01AZ14G.48.43.D10.1.454.CMB.1.raw
  modified_base (294)..(294): a, c, t, g, unknown or other
  misc_feature (294)..(294): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctggtgggagacagagtccaccctcacgttgccgggacaagtcaggcctatttccaatttctttagcctggtatcagacagaaaccagacaaactcctaacactcctnatctatgatgcgtactagttagagacggtcgggcccagtcgaggtcaggcgcgagtggatcgagggacagtagtcactctacacatcagcacgcctgacacgtacctagtaagttattttacgacttaactttattactacgtactaaacttaactttaaacaacttaccctataactaacgtccgttacgaccgaaacgggtacccaagggtaacggaaaccaaggaccgtaaacgtcggtagacctcgaccacctactcgttgttacc

SEQ ID NO: 279524 - DNA, 560 bp, Homo sapiens
  misc_feature: GYAE6OF01AVK6B.48.43.D10.1.454.CMB.1.raw
  modified_base (418)..(418): a, c, t, g, unknown or other
  misc_feature (418)..(418): n is a, c, g, or t
tcagagtatacatacacgaccggtgctcgatttagactagcagtaagggggcaggagtcagacccactcaggacacagcatggacatgagggtccccgctcagactcctggggcttctgctgctctggctcccaggtgccagatgtgacgtccagttgacccagtctccatcctccctgtctgcatctgtgggagacagagtcaccctcacttgccgggcaacgtcaggccatttccaattccttagcctggtatcagcagaaccaggacaactcctacactcctgactctatgatgcgtacctagtttagacgaggtcgggcccagtcgaggttcaggcgcgagtggatcgagggacaggtattcactctacaccatcagcagccctgcacgcctagaagttatttgactaactttntactgtactaactaactttaaccaactttaccctataagttaacgtccgttaccggacccgtaacgggacccgtaggtaaccgaaaccgtaagaccgtaaacgtcggtaggacctacgaccaacctacttcgttagttcccg

SEQ ID NO: 279525 - DNA, 1064 bp, Homo sapiens
  misc_feature: GYAE6OF01AX1H7.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtcctccatccctccctgtctgcatcgtggtgggagacagacgtccaccctcacgttcggcccgggacaacggtccgacgggtcccttaacttttacccaaattttccttttaacggtccccgttaggggttaacttccgaaggaccaaacggaaaaaacccgaacggggtaaacctaaaaacccgttacccctaaacctaacccttccccttacggtaactttccgttaattggaacgtttcggtaccggtttaccctaagggtttttaagggaacgggtacggggttaccggggggtacccccctaagttaccggggtaacggggtttcccgtaacggggacccgggtaccgtaaggggttacgggtaacgttacccggaaagggggtaaacccgtaagggttaacggtttaaccctaacccggtttacccttaacccgaaccccgtaagttaccccgaacgggttaacccgaaaccggggtcccccttaacgggacccgtaaaccggttacccccggttaagggttaaaacgggtttacgttttttaaccgggtaaacccgtttaaacctttttaaacgtttttaacccggttaaccggtttaaacccttaaaaaccccggttttaaacccttttttaaaaacccgtaaaacccttttttaaacccccccgtaacgtttaaaaccggtttaaacccgggtttaccccccgggttttaaacccgggggaacccccggttaaaaacccgggggggtaaaccccccctaaaggggggtttaaaacccgggaaaaaccccctaaagggggtaacccggttaaaaccggtttacgggtaccgggtaacccgtaccggtacccttaaaccccggttaagtttcccgttacgggttttaaccccc

SEQ ID NO: 279526 - DNA, 584 bp, Homo sapiens
  misc_feature: GYAE6OF01CEC93.48.43.D10.1.454.CMB.1.raw
  modified_base (210)..(210): a, c, t, g, unknown or other
  misc_feature (210)..(210): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagagtccaccctnacttgccgggcaagtcaggccatttccaattctttagcctggtatcagcagaaaccaggacaaactcctacactcctgatctatgatgcgtccagtttagagagtcgggccccatcggaggttcagcggcagtggatcgagggacagacgttcactctccacatcagcacgcctgcacgcctagaagttacttttacggaccttaacgtttactttaacttgttacctaaacttaaccttttaaaccaactttaaccctactaagttaaccggtcccgtttaaccgggaccgtaaacgggacccgaaacgggtacggaaaacccgaaggaaccggtaacgcggtcgacgttcgaccaccgacttcgttcgttcc

SEQ ID NO: 279527 - DNA, 555 bp, Homo sapiens
  misc_feature: GYAE6OF01D1QN3.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtccaccctcacttgccgggcaagtcaggccatttccaattcttagcctggtatcagcagaaaccaggacaaactcctacactcctgatctatgatgcgtcctagtttagagagtcggggccccagtcgaggttcagcggcagtggatcgagggacagagttcactctcaccatcaagcagcctgcagcctagtaagtattttcgactaactttattactgtacaaacttactttaaactaacttaccctactaataacgtccgttacgggaccaaacggggtaccccaagggtaccggaaaaccaaggaccgaaacgtggtacggctacggacccacctactccgttggttaccc

SEQ ID NO: 279528 - DNA, 591 bp, Homo sapiens
  misc_feature: GYAE6OF01A2NY6.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggcctatttccaattcttagcctggtatcagcagaaaccaggacaactcctacactcctgatctatgatcgcgtccagtttagaggtacggtcggggcccctagtcggacggttcgaacggcgggcaggtgggaatcggaagggaccgaggtacgttccacgtctaccgaccacgtcacgcagtccctagccagtcctagtaagttactttagacctaacttattactacgtataaaacggttcttactacgtttaccgcccccttatcccgtaccgttccgggaccctaagggacctaaccggtacgtacggaagtaacttaaaccgtacgtagtacggtcgtacgacctaacctagtcgttacg

SEQ ID NO: 279529 - DNA, 557 bp, Homo sapiens
  misc_feature: GYAE6OF01EWPOC.48.43.D10.1.454.CMB.1.raw
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctggtatcagcagaaaccaggacaaactcctacactcctgatctatgatgcgtccagtttagagagtcggggcccatcgaggttcaggcggcagtggatcgagggacagtagttcactctacaccataccagcacgcctagtacgcctaggaacgttattttcgactaactttattactgtacaacctaacttttaacaactttaccctactaacttaacgcccgttacggaccaacgggtacccaggtaacggaaaccgaacggtaccgaacgtggtacggacctaggaccacccgtatcttgtccttac

SEQ ID NO: 279530 - DNA, 558 bp, Homo sapiens
  misc_feature: GYAE6OF01D8P5M.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagacgtcaccctcacttgccgggcaagtcaggccatttccaattctttagcctggtatcagcagaaaccaggacaaactcctacactcctagatctatgatgcgtccagtttagagaggtcggggccccagtccggaggttcgagcgggcaggtggagtcgaggggacaggtagttcacgtctcaccatcagcacgccctgccagcctagaagtatttgactaatttacttactgtacctaactactttaacaactttaccctactactaacgtccgttacggaccgaacgggacccgaaggtacggaaacccgaaggccgtaaacgttgtacggaccgtcgactaccacttcgtcgttccg

SEQ ID NO: 279531 - DNA, 660 bp, Homo sapiens
  misc_feature: GYAE6OF01CYP9X.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatcctccctgtctgcatctgtgggagacagagtccaccctcacttgccgggcaagtcaggccatttccaattcttagccttggtatcagcaacgaaaccaggaaccaaactcctaacacctcctagtactctagtgatcgtcgtacctagtttaggagtacggtccggggacccctagtccggtaggttacgacggcggacgtaggtaggatcggaaggggacgtaaggtacgttacacttcgtaccaccgtaactaccaggtaccacggcccttgaccgacgtcctaggtaacgttactttcgacttaacgtttattaccttagtaacctaaacttaacctttaaactaacctttcctaactaattaaccggtccgttaccggaaccgtaacgggtaccctaagggtaaaccggaaaccgtaagtaccggtaaacgttcggtcggtaccgttaccggtaaccgacccttaacgttcccgttagttacccg

SEQ ID NO: 279532 - DNA, 570 bp, Homo sapiens
  misc_feature: GYAE6OF01D4YX9.48.43.D10.1.454.CMB.1.raw
  modified_base (194)..(194): a, c, t, g, unknown or other
  misc_feature (194)..(194): n is a, c, g, or t
  modified_base (313)..(313): a, c, t, g, unknown or other
  misc_feature (313)..(313): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtccaccctcacttgccgggcaagtcaggcctatttccaattctttagcctggtatcagcaagaaccaggaacaaactcctacactctgatctatgatgcgtctagtttagagnggtcgggcccagtcggaggtcaggcggcgaggtggatcgagggacagtacgttcactctcaccatcagcacgtcctgacacgcctagaagttctttacgacttaactttattactagtaactaacttaaccttaacaactttaccctactaacgtaaccggtccgttaccggaaccgtaacgggaccgaacgggtaacggaaaaccgacggacggtaacgtggtcggtaccgtacgacccactacttccgttgtacc

SEQ ID NO: 279533 - DNA, 613 bp, Homo sapiens
  misc_feature: GYAE6OF01AKI8S.48.43.D10.1.454.CMB.1.raw
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatcgtgtgggagacagacgtcaccctnacttgccgggcaagtcaggccatttccaatttcttagcctggtatcagcaagaaccagacaactcctacnctcctnatctatgatgcgtcagtttagaggtagtcgggcccagtcgaggttcagcggcagtggatcgagggacaggtagttcactctcacatcgagcagccctgaccgacgtcccgtagtaaacgttactttttcggaccttaaacctttacgtttaaccttacgttaacctaaaccgtttaaccttttaaaccgtaaacctttacccctactaacgttaaccggtcccggttaccggacccgtaacgggaccccgtaaggtaaccggaaaccgtacggtacggtaaaccgttgggtacggtactcgacccaccgtacttccgtcgttacccg

SEQ ID NO: 279534 - DNA, 628 bp, Homo sapiens
  misc_feature: GYAE6OF01DM0T0.48.43.D10.1.454.CMB.1.raw
  modified_base (99)..(99): a, c, t, g, unknown or other
  misc_feature (99)..(99): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtcgccagatgtgacgtccagttgacccagtctccatccctcctgtctgcatctggtgggaacagacgtccacctcacgttgccggacaagtcaggcctatttccaatttcttagcctgtatcagcaagaaccagaacaactcctacactcctagacttcgatgatcgcgtactagtttagagtacggtcgggaccctagtcggtacggttacgacggtcgacgtaggtacgacgtacggagggacgagttacgttacactctacaccgtatacagacacggtcctacgactacgactacgtaagttcttttaacgacttaactttacttactacgtaaccttaacttaacgtttaacctaacctttacccataacgttaaccggtcccgttaccgaaccggtaaccgggaaccgtaagggtaaacccgaaaccgaggtacgtaaacggttggaccgttacctaccaaccgtatacccgttgttcccttaaccg

SEQ ID NO: 279535 - DNA, 704 bp, Homo sapiens
  misc_feature: GYAE6OF01DJXHC.48.43.D10.1.454.CMB.1.raw
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
tcagagtatacatacacgaccggtgctcgatttagactagcagtaagggggcaggagtcagacccactcaggacacagcatggacatggagggtccccgctcagctccgtggggcttctgctgctctggctcccaggtgccagatgtgacgtccagttcgaccagtctccactcctccctgtctgcatcgtggtgggagacaggtactcaccctnacgttgccgggacaagtcaggcctatttcctaatttctttagccttggtactcagacaacggaaaccaggaactaaactcctaacactcctanacttcaatgatgaccgtacctagtttaggacgacggtcggggacccctagttcggtaacggttcgaacggtcggacgaggtaggacgtacgaggggacaggtacgttccactactacaccgtatcagccaaggtccctaggacagggtaccctaaggtaacgttatttacgacttaaacgtttaacttacgtactaaacctaacttaaacttttaaaccctaactttaacccctaacgtaactttaacggtaccccggtttaaccggaaacccggtaaacgggttacccgggaaaacgggttaaaccggaaaaacccgtaaagggacccggttaaacgttacgggtacggttacccgtaccgaacccgtaacccttagtcccgttcggtttaaccc

SEQ ID NO: 279536 - DNA, 542 bp, Homo sapiens
  misc_feature: GYAE6OF01DG59H.48.43.D10.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (450)..(450): a, c, t, g, unknown or other
  misc_feature (450)..(450): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtccaccctnacttgccgggcaagtcaggccatttccaattctttagcctggtatcagcaagaaaccaggaaccaaactcctacactcctgatctatgatgcgtctagtttagagagtcgggcccagtcgaggttcagcggcagtggatcgaagggataggagttacactctcactatcagcacgcctgacacgcctagaagttatttcgactaactttatactgtacaactacttaactaacttacctanacttaacgtcgttacgaccgtaacgggaccgtaggacgaaaccgtaagacgtaacgtgtacggcctacggaccctaccgtactcgttgttcc

SEQ ID NO: 279537 - DNA, 610 bp, Homo sapiens
  misc_feature: GYAE6OF01AYUWX.48.43.D10.1.454.CMB.1.raw
  modified_base (176)..(176): a, c, t, g, unknown or other
  misc_feature (176)..(176): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacgcccatgctgcaaggtcgggccagaggtcgcccctgaacctgaaggccaatgagacccaagacaggccaaggtgggttgtgacggacccctgaggagcgtgggccctggtcccaggcagcgctggccctgctgctgctgggtctggcagtcggtcgcccgagtcggcctgctcgcgcccaagtcggttgcctaccgcgaaacggcccggggaaccccacgggacccctcgggacgccgtcgaggttcggaacggccaggcccgacgttcccaaggtcccgtacggcggacgtccgtggtcggggcacgggtccacgggccccgaagggtcccaccgggtccccccgtacggtaccctccgttcccgttccgttacccccccg

SEQ ID NO: 279538 - DNA, 641 bp, Homo sapiens
  misc_feature: GYAE6OF01CJW0V.48.43.D10.1.454.CMB.1.raw
  modified_base (252)..(252): a, c, t, g, unknown or other
  misc_feature (252)..(252): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagnggtcgccctgaacctgaaggccaatgagaccaagacaggccaagtgggtgtgagacccctgaggagcgtcgggcccgtcggtcccaggcagcgcgtcggccctgcctgcgtgcgtgggtcgtcggcctagtcggtccgcccgtacgtcgggtcctcggccgttcggccgtacccgtaagttcgggttcgccgaaccggacgaaacggccggggaaccccgacggacccgtcggaccgtcccgtcgtacggttacggaacgcgacggtcccgtacgtccgacgtccgtcggccggacgtccggtgggtcgggccgacggtccgacggcccgaacggtcccgtaccggtcccccgttcggtaccctcccgtcccgttcccgttccccccgg

SEQ ID NO: 279539 - DNA, 902 bp, Homo sapiens
  misc_feature: GYAE6OF01BDWAX.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatcctccctgtctgcatctggtgggagacagacgtccaccctcacgttcggccgggactaacggtcgacggtccttaacttttacccgaaattttcgtttaacgtcccgttagggttaactccgaaggaccaaacggaaaaccgaacggaaacctaaaaccttccctaacctaccttaccttaggtaacttacctaagtagtacgttcgtccggttaccttaaggtttaaggaacgggtacggttccgggggtaccccctaaggttaccggtaacgggtttaccgacggggtaccggtacgtagggtacggaacgtaccgggaaacggggtaacgtaaacgggttaccgtttacccgaaccgtttccccgtaaccgaacccgtaacttacccggaacggacccgttaaacgggtccccgttaacggaaccgtaccggtacccgttaagggttaaacgtttaccgttttacgaaccttttaaacgttttacgtttaaccgtaacgttaaaccctaaacctttaaacccttttaaaccgtaaaccttttaaccccgtaacgttaaacgttaacccggttacccggttaacccggaaacccggttaaacccgggtaacccgtaaaccgggggttaaaccgaaaaacccggtaaggtaacccggttaaacggttacccggggttagaacccggttaccgaaccccgttaacgtacgtttcccgtaccgtttaacccg

SEQ ID NO: 279540 - DNA, 544 bp, Homo sapiens
  misc_feature: GYAE6OF01BUVZY.48.43.D10.1.454.CMB.1.raw
  modified_base (355)..(355): a, c, t, g, unknown or other
  misc_feature (355)..(355): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtcgggccccatcgaggttcagcggcaggtgatcgagggacagngttcactctcaccatcagcagcctgcagcctagaagttatttgactaactttattactgtactaactaactttaacaactttaccctataacttaacgtccgttacggaccgtaacgggacccgaaggtacggaaaccgtaaggacgtaacgttcggtcggactcgacccacgacttccgtggttaccc

SEQ ID NO: 279541 - DNA, 605 bp, Homo sapiens
  misc_feature: GYAE6OF01BKMDR.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagagtccaccctcacttgccggcaagtcaggcctatttccaattcttagcctggtatcagcaagaaccagacaaactcctacactctgatctatgatcgacgtctagtttagaggtacggtccgggacccctagtccggtaggttcgaggcggacgaggtggatcggaagggacagtacgttccacttctacacctataccgagcacgtccgtagacacgtccgtagtaacgttattttacgacttaactttacttactagtaacctaaacttaactttaaaccaactttaaccctataacgttaacggtacccgttaaccggaccgtaaaccgggtacccgtaagggtaaccgaaaccgtaaggacggtaacgtcggtacgacgtcgactacctatccgtgttaccc

SEQ ID NO: 279542 - DNA, 593 bp, Homo sapiens
  misc_feature: GYAE6OF01CD751.48.43.D10.1.454.CMB.1.raw
  modified_base (377)..(377): a, c, t, g, unknown or other
  misc_feature (377)..(377): n is a, c, g, or t
tcagagtatacatacacgaccggtgctcgatttagactagcagtaagggggcaggagtcagacccactcaggacacagcatggacatgagggtcccccgctcagctcctggggcttctgctgctctggctcccaggtgccagatgtgacgtccagttgacccagtctccatccctccctgtctgcatctggtgggagacagagtccaccctcacgttcggcccggggacaaggtcaacgaccctaattttcctaatttctttagccttggtatcagacaacgaaaccaggaaccaaacctcctacactcctgactctaatcgatcgcgtcctaagtttagaggtacggtcggggacccagtcggaggttcagtcggnagtggatcgagggacagtagtcactctcacatcagcacgctagcaacgtctagtaagttagttttcgacttaacctttattacttagtacaaacttaacttaaactaacttaccctataacgtaaccgtccgttacgaccgaacggacccgtaagggtacgaaaccgaggacggaaccgttggcgtactacggacctaccctattccgttgttccc

SEQ ID NO: 279543 - DNA, 557 bp, Homo sapiens
  misc_feature: GYAE6OF01CTHTL.48.43.D10.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctnacttgccgggnaagtcaggccatttccaattctttagcctggtatcagcagaaaccaggacaaactcctacactcctgatctatgatgcgtcctagtttagagaggtcgggccccagtcgaggttcgagcggcaggtggatcgagggacagagttcactctcaccatcagcagccctgacagcctagaagtatttgactaatttacttactcgtactaacctaactttaactaacttaccctactaacttaacgtccgttaccggaccgtaacgggacccgtaaggtacggaaacccgaaggaccgtaaacgtggtaacggcgtacgacaacctacgtccttgttaccc

SEQ ID NO: 279544 - DNA, 522 bp, Homo sapiens
  misc_feature: GYAE6OF01E3ND5.48.43.D10.1.454.CMB.1.raw
  modified_base (512)..(512): a, c, t, g, unknown or other
  misc_feature (512)..(512): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtgatcagggacagagttcactctcaccatcagcagcctgcagcctgaagtattttgactaactttattactgtacaactaactttaacaactttaaccctctaataacgtccgttaccggaccaacgggacccaggtacggaaaccgaagacgaacgtgtggactgccaaccncttctgttcc

SEQ ID NO: 279545 - DNA, 647 bp, Homo sapiens
  misc_feature: GYAE6OF01E0Z8L.48.43.D10.1.454.CMB.1.raw
  modified_base (317)..(317): a, c, t, g, unknown or other
  misc_feature (317)..(317): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggagcccatgctgcaagtcggcagaggtgcccctgacctgaagccaatgagacccaagacaggaccaaggtggttgtgacgacccgtgaggngcgtgggccctggtccaggcagcgcgtcgccctgctgctgcgtggtcgtcggcctagtcggtaccgcccgtagtcggccgttgcgtcgccgcctaagttcgggttcgcgaaccgcgaaacggccgggaacccacggacccgtggaccgccgtacgacggttaggaacgccgaacggccgtacgtcccgacgtcccgtcggaccggtacggtcccgttcggggtcggggtaccgtacgggtacgaccggtaccccggaaacgggtccccgtacccggtccccccgggttacggtccccgtaacccgttcccgttccccggttacccccccg

SEQ ID NO: 279546 - DNA, 714 bp, Homo sapiens
  misc_feature: GYAE6OF01C93RB.48.43.D10.1.454.CMB.1.raw
  modified_base (641)..(641): a, c, t, g, unknown or other
  misc_feature (641)..(641): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccgaggagaggacagagccaagtggacgtggggtgtactagtaacacgccctgcgtggcgaggagggaccagggccaccgtcctccgagggacgcccagtgccgtgcgaaggtccgggaccgaggacgggtccgccccgttaggaaacccgtaggaaacggaccgaagtcggaaacgaacccgaaacggacgaacggaccgtaaggtgggttacgtacggaaccggaccccgtaggaacggtacggtccggtcgggcccgttcgggtaccccgaggccgacggccgtccgtccggccccgtgtccgtcgccgttcggccggttacgggtccgtcgggtcctagtccgggtcccgcccgtacgtcggcccgtggccgtcggaccgtacccgtagttcggtacgaccgaccggaccggaacggccggaccgacgccgacgcgccgtagacggtagaacgacgacgaccgtacgccgcgccgtggccggtacgcggtcggngggccgtacggccacggcccgacggccctcccggtaccccgtcggtaccctaccgttccgtccccttaccccg

SEQ ID NO: 279547 - DNA, 605 bp, Homo sapiens
  misc_feature: GYAE6OF01COOPY.48.43.D10.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (424)..(424): a, c, t, g, unknown or other
  misc_feature (424)..(424): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatccctccctgtctgcatcgtgtggganacagacgtcacctnacgttcggccggacaagtcacgcctatttccaatttcttagccttaggtactcagacaacgaaaccagaactaaactcctacacctcctagtactactatcgactcgtacgtacctaagtttacgaggacggtcgggacccctagtccggtagttcgaagggcggacgaggtaggactacgaagggactaggtacgttacacgtcacctaacntacagacacgtcgtagacgacgacgtagtagttatttacgacttaacttattactacgtaactaaacgttaacttaacgtaaccttacctactaacgtaacgtccgtacgacggtaaccggacgtaaggtaacggaaaccaagtacgacgtagtcgactcgaaccatacgtcgtattcccg

SEQ ID NO: 279548 - DNA, 642 bp, Homo sapiens
  misc_feature: GYAE6OF01DB2UB.48.43.D10.1.454.CMB.1.raw
  modified_base (294)..(294): a, c, t, g, unknown or other
  misc_feature (294)..(294): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatccctccctgtctgcatctgtgggagacagacgtccaccctcacgttggccgggcaagtcaggcctatttccaattctttagcctggtatcagcaagaaccaggaacaaactcctacactcctnatctatgatgcgtaccagtttagaagacggtcggggcccagtcgtaggttcaggcggctaggtggatcgagggacgagtagttacactctacacactcgacgcacgtcctgacacgtccgtagtaagttcttttacgacctttaactttattaacttgttaacctaaacttaaccttttaaacctaaccgtttacccctagtaaacttaaccggtcccggtttaccgggaaccccgtaaacggggaaccccgtaacggggttaaacgggaaaaccccgtaaggacccggttaaacggttcgggtacggtaccgttacggacccaccgttaactccgtttggttacccc

SEQ ID NO: 279549 - DNA, 598 bp, Homo sapiens
  misc_feature: GYAE6OF01ECH0J.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagagtccaccctcacgttgccgggcaagtcaggcctatttccaattcttagcctggtatcagacaagaacagacaaactcctacactcctgatctatgatgccgtactagtttagagtacggtcgggaccctagtcggagttcgaggcggcgaggtggatcgagggacaggtagttcactctacaccatacgacgcacgcctagacacgtcctaggtaacgttactttagacttaactttacttacttacgtaactaacttaactttaactaaccttaccctactaacgttaaccggtaccgtaccggaaccgtaaacgggtacccgtaagggtaccggaaaacccgaaggacgtaaaccggtggtacggcgtaccgactaacctacgttccgtgttaccc

SEQ ID NO: 279550 - DNA, 564 bp, Homo sapiens
  misc_feature: GYAE6OF01CNXKT.48.43.D10.1.454.CMB.1.raw
  modified_base (194)..(194): a, c, t, g, unknown or other
  misc_feature (194)..(194): n is a, c, g, or t
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtccaccctcacttggccgggtacaagtcaggcctatttccaattctttagcctggtactcagcaagaaaccaggaacaaactcctacactcctgatctatgatgctcctagtttagagtgtcgggccccagtcgaggttcaggcggcgaggtgatcgaagggacagtacgtcactcncacatcagcagcctgcacgcctagaattnttagactaactttattactagtacctaaacttaactttaaactaaccttacctataacgttaaccgtccgttaccggaccgaaacgggtacccgtaaggtaacggaaaccgacggacgtaaacgtgtcgacgtcgacctacctactcgttcgttaccg

SEQ ID NO: 279551 - DNA, 933 bp, Homo sapiens
  misc_feature: GYAE6OF01C1N6U.48.43.D10.1.454.CMB.1.raw
  modified_base (195)..(195): a, c, t, g, unknown or other
  misc_feature (195)..(195): n is a, c, g, or t
tcagagtatacatacacgaccggtgctcgatttagactagcagtaagggggcaggagtcaggacccactcaggacacagcatggacatgagggtccccgctcagcctccgtggggcttcgtcgcctcgcctctcggcctccccaggtcgccagatgtgacgtccgagttcgacccagtctccatccctcctgtcncgccactcgtggtgggacgacgacgcgtccacccgttcaccgttggccgggtactaacggtcgagggtcctacttttacctaacgtttccgtttaacggacccgttagggttacttccgaacggtacgtaaaccggaaaaacccgaggtaaaccctaaaaccttcccctaaaccaacccgttaccgtaccgtaacttccttaagtcgaacgttcggtaccgttaaccgtaaaggttttacggaagggtacggtacccgggggaccccctaaaggttaccggggtaacgggtttaccaaacgggtccgggtaaccgtaggggtttacgggaacgttaccgggaacggggtaactacgggttaacggttcctaaacccgttcccgttaacccgaacccgtacttaccggaaccgacgtaccggtacccgttacggaccggtaccgggtaaccgttaacgggtaacgtttaacggttttaaccggaactttaaaccctttttaacggtttaaccgttaccggttaaacccgtaaacctttaaaccgttttaacccgtaaaacccggttttacccctaaacgttaaacggttaacccggtacccgggtttaacccggaaccgggtaacccgggtaaccggtaaacgggttaacccgggaaaacccgtacgggtaaacccgtaacggtccggttacgggaaccctaaccggtacgtaaaccgtcgttccgtacgtttaccccg

SEQ ID NO: 279552 - DNA, 557 bp, Homo sapiens
  misc_feature: GYAE6OF01DU4E9.48.43.D10.1.454.CMB.1.raw
  modified_base (405)..(405): a, c, t, g, unknown or other
  misc_feature (405)..(405): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtccaccctcacttgccgggcaagtcaggccatttccaattctttagcctggtatcagcaagaaaccaggaacaaactcctacactcctgatctatgatgcgtctagtttagagagtcggggcccagtcgaggttcaggcggcgaggtggatcgaagggacaggtagttcactctcaccatcagcacgcctgcagcctagaagttntttcgactaactttattactgtactaactactttaaacaacttaccctataactacgtcccgtacgaccgaacggacccgtagggtaacggaaaccgtaagaccggtaacgtcggtacggtacctcggaccctaccgtacttctcggttacc

SEQ ID NO: 279553 - DNA, 551 bp, Homo sapiens
  misc_feature: GYAE6OF01EO8M1.48.43.D10.1.454.CMB.1.raw
  modified_base (196)..(196): a, c, t, g, unknown or other
  misc_feature (196)..(196): n is a, c, g, or t
  modified_base (405)..(405): a, c, t, g, unknown or other
  misc_feature (405)..(405): n is a, c, g, or t
  modified_base (530)..(530): a, c, t, g, unknown or other
  misc_feature (530)..(530): n is a, c, g, or t
  modified_base (541)..(541): a, c, t, g, unknown or other
  misc_feature (541)..(541): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctggtggganacagacgtccaccctcacttggccgggcaagtcaggccatttccaatttcttagcctggtatcagcagaaccaggacaaactcctacactcctgactctatgatgcgtactagttagagagtcgggcccagtcgaggttcagcgcgagtgatcgagggacagtacgtcactctcaccatcgagcacgcctgctacgcctagtaacgttntttacgaccttaacgtttaacttactacgtacctaaacttaactttaaacctaacgtttaccctagtaactaaccgtccgtacggtaccgaacggtaccaggtacgaaaccgagacgagtacggngactgacctanttctgttacc

SEQ ID NO: 279554 - DNA, 584 bp, Homo sapiens
  misc_feature: GYAE6OF01AR9LY.48.43.D10.1.454.CMB.1.raw
tcagagtatacatacacgaccggtgctcgatttagactagcagtaagggggcaggagtcagacccactcaggacacagcatggacatgagggtcccccgctcagctcctggggcttctgctgctctggctcccaggtgccagatgtgacgtccagttgacccagtctccatcctccctgtctgcatctggtgggagacagagtccaccctcacttgccgggcaagtcaggccatttccaatttcttagcctggtatcagcagaaccaggacaactcctacactcctgatctatgatgccgtcagtttagagagtcgggcccagtcgagttcagcgcagtggactcgaagggacaggacgttcactcctacacctatcagcacgtccctagcgagtacccgtaggtaacgttatttacgacttaactttaattacctacgttaacctaaactaaccttttaaaccgaactttaacccgtactaacgttaaccgtcccgttccggaaaaccgtaccgggacccgtaagggtacgaaacccgaggtacgtaacgtggtacgacgtcgactacctcgttcgtgttacc

SEQ ID NO: 279555 - DNA, 611 bp, Homo sapiens
  misc_feature: GYAE6OF01A18ZE.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtccacctcacttgccggcaagtcaggcctattccaattcttagcctggtatcagcagaaacagacaacctcctacactcctagattctatgatcgtcgtactagtttagagtacggtcgggaccctagtcggtaggttcaacggcggacgagtcggactacggaacggggactaaggtacgttacaccttctaccgacctaagtccaagacgtacgtccgtaggtacgaccgttagtaacgttactttacggtaccttaatttacttaacgtacgttaacctaacgttaacctttaaactaccttaccctagtaacgtaccgtccgtaccggacgaaccggtaccgtaggtaaccgaaaccgaggtacgaacgtggtacgtacacgtacctactagttcctgttccgtacc

SEQ ID NO: 279556 - DNA, 685 bp, Homo sapiens
  misc_feature: GYAE6OF01BI7GJ.48.43.D10.1.454.CMB.1.raw
  modified_base (348)..(348): a, c, t, g, unknown or other
  misc_feature (348)..(348): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtccgggcaggaggtgcccctgaacctgaaggccaatgagacccaagacaggccaagtgggttgtgacgaccccgtgaggagcgtgggccctcggtcccaggcaggcncgtcggcccctgctgctcgctgggtctggcctagtcggtccgcccgtagtcgggtcctcggcgtcgcccgtaccctagtcggttcgaccgacccgtacgaaaccggccggggaaccccacggaacccgtggaccgcccgtacgtagggttcggaacgtccgacggaccgacgttacccgacgtcccgtacggaccggggaccgtaccggttcggggtaccgggggtcggtaaccggggtaccgtaccgggacccccgaaacggggtccccggttacccgtccccccgggttaccggttacccgtaacccttccccgggttacccgttccccccccgg

SEQ ID NO: 279557 - DNA, 545 bp, Homo sapiens
  misc_feature: GYAE6OF01BDYOB.48.43.D10.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggnaagtcaggccatttccaattcttagcctggtatcagcagaaccaggacaaactcctacactcctgatctatgatgcgtccagtttagagagtgggccccagtcgaggttcagcggcagtggatcgagggacagagttcactctcaccatcagcagcctgcagcctagaagtatttgactaactttatactgtacaactactttaaacaacttaccctactaagttaacgcccgttacggacccaaggggtacccctaagggtaacgaaaccaacggaccgaaccgttggtacggccttacgacctaaccgattccgttggttaccc

SEQ ID NO: 279558 - DNA, 785 bp, Homo sapiens
  misc_feature: GYAE6OF01DE6VZ.48.43.D10.1.454.CMB.1.raw
  modified_base (205)..(205): a, c, t, g, unknown or other
  misc_feature (205)..(205): n is a, c, g, or t
tcagagtatacatacacgaccggtgctcgatttagactagcagtaagggggcaggagtcagacccactcaggacacagcatggacatgagggtccccgctcagctccgtggggcttctgctgctctggctcccgaggtcgccagatggtgaccgtccagttcgacccagtcctccactccctcctgtctgcattcgtggtggganacgagtactccaccctctacgtcggccgggactaacggtcacggtcctatttacctaattttcgttacgccgttggtactcgacgacgaacgaaaccaacggaacctaaacctcctaactaccctcgtatactactagtcgactcggtacctacgtaaggtttacggacggtacgggtccgggaccctacgttcggacggttcgagggtcccggtaggtagggttggaacgttcggaacggggtaacgtacgtacgtttaccgacctaccgtacctaaccgtacgtacgaccgtaccgtaccgtccgtaccggaccgtaaccgtaccggttaacggttaaacgttacgttttacgtaacctttaacgtttaactttacgtaccgttaaaccttaacccgttaaactttaaccttaaacccttacccttaacgttaaccgttaacccgggttaccggtaacccgggtaacccggtaaacccgggtacccggtaaacgggtaaaccggaaaccggtaacggtaacggttccggtacggtaccggtacgtaccgacgtaaccctcgtttcgtccgtttacccg

SEQ ID NO: 279559 - DNA, 690 bp, Homo sapiens
  misc_feature: GYAE6OF01DH97Q.48.43.D10.1.454.CMB.1.raw
  modified_base (99)..(99): a, c, t, g, unknown or other
  misc_feature (99)..(99): n is a, c, g, or t
  modified_base (200)..(200): a, c, t, g, unknown or other
  misc_feature (200)..(200): n is a, c, g, or t
  modified_base (679)..(679): a, c, t, g, unknown or other
  misc_feature (679)..(679): n is a, c, g, or t
tcagagtatacatacacgaccggtgctcgatttagactagcagtaagggggcaggagtcagacccactcaggacacagcatggacatgagggtccccgntcagctccgtggggcttctgctgctctggctcccaggtgccagatgtgacgtccagttcgacccagtctccattccctcctgtctgcattcgtggtggganacagacgtccaccctctacgttcggccgggacaacgtcacggtcctaacttttccaatttcgtttacgccttggtactcgacgacgaacgaaaccgaggaacctaaacctcctaaccacctaccgtagtaacttcctagtacgtacgtcggtaccgttaccgttaaggtttaacggacggtacggtccggggtacccctaggttaccggtaacggttaccgacggtcggtacgtaggtacggacgtacggaacgggtactaacggtacgttacctaccgtacctacccgaaccgtactacgacgaccgtaacgtccgtacggcctaacgtaccgtagtaacgttacgttttacgacctttaactttacttacgtacgtaactaacttaaccttaactactacctatacgtacgtccgtaccgacgtaacggaccgtaaggtacgaaacgacgacgtacgtcggtagcgtacgactactnttcctgttacc

SEQ ID NO: 279560 - DNA, 558 bp, Homo sapiens
  misc_feature: GYAE6OF01BDKH8.48.43.D10.1.454.CMB.1.raw
  modified_base (98)..(98): a, c, t, g, unknown or other
  misc_feature (98)..(98): n is a, c, g, or t
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (340)..(340): a, c, t, g, unknown or other
  misc_feature (340)..(340): n is a, c, g, or t
  modified_base (392)..(392): a, c, t, g, unknown or other
  misc_feature (392)..(392): n is a, c, g, or t
tcagagtatacatacacgaccggtgctcgatttagactagcagtaagggggcaggagtcagacccactcaggacacagcatggacatgagggtccccntcagctcctggggcttctgctgctctggctcccaggtgccagatgtgacgtccagttcgacccagtcctccatcctccctgtctgcatctgtggganacagacgtccaccctcacttcggccggcaacgtcaggcctatttccaattcttagcctggtatcagcagaaccaggacaactcctacnctcctgatctatgatgcgtctagtttagagtagtcgggcccagtcgaggttcagcgnagtgatcgagggtacagtacgtcactctacacctagtacagcacgcctgacncgtacctagtaacgtatttcgacttaactttactacgttcgtaactaacttaactttaaccaacttaccctataacgtaacgtccgttaccggaccgtaacggtacccgaaggtacgaaaccgagaccggtactcgtacggtctacgacctacgctcgtcgttacc

SEQ ID NO: 279561 - DNA, 539 bp, Homo sapiens
  misc_feature: GYAE6OF01EQ264.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggcctatttccaattcttagcctggtatcagcagaacagacaactcctacactctgatctatgatgcgtctagttagagagtcgggccctagtcgaggttcaggcgcgagtggactcgaggacagtagtcactctcacatacagcacgcctgacagtcctagtaagtactttacgacttaacttattactacgtactaactaactttaacctaacttaccctactaacgttaacgtccgttacggaccgaacgggtaccaagggtacgaaaccaaggcgtaactggtagcgtacgacctaacgtctcgtgtacc

SEQ ID NO: 279562 - DNA, 717 bp, Homo sapiens
  misc_feature: GYAE6OF01CBA7E.48.43.D10.1.454.CMB.1.raw
tcagagtatacatacacgaccggtgctcgatttagactagcagtaagggggcagttggtagatgcccctctgggagagatccccgaggggtgacagccatggaccctggaagggcctgggctagggacagggaccagagccagtccagggagaggacagagccaatggactggggtgtactgtaacagccctgctggcgaggagggaccaggggcaccgtcctccgagggacgcccatcgctgcgaaggtccgggccaggacggtcgccccgtagaaccgtgaacgggccaaagtcggacgaacccaaggaacacggaccaaggtggggttgtggacgaccccgtggaggacgcggtcggggtccccgtgggtcccaggcgacgcgccgtcggcccctggcctgctcggcgtgggtctggcctacgtcggccgccagtcgggcctggctcggcccgtccagttcggtacgccgaccggacgtaacgggcccgggaacccacggacccgtggaccgaccgtcgtaacggttacggaacgcgaccggaccgtaacgtccgaacggtccgtacggccggtacgtacccggttgggccgggggtactccggggttaaccgaaccgggaccccggtaaccgggtacccgttaccccggggtcccccgttacccgggttaccccgtacccggtttcccggttccccgggtttaacccccccgg

SEQ ID NO: 279563 - DNA, 1049 bp, Homo sapiens
  misc_feature: GYAE6OF01DG0RX.48.43.D10.1.454.CMB.1.raw
  modified_base (200)..(200): a, c, t, g, unknown or other
  misc_feature (200)..(200): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgaccctagtcctccactcctccctgtctgcattctggtggganacagacgtccaccctcgtacgttcggaccggactaacggtccacgggtcctaacttttacccgtaagttttaccgttttacgtcccgttaggttacttacgaacggacctaaacggtaaaacccgacggtaaaccctaaaaccttaccccttaacctaaccttccgttaagtaactttcgttaagtacgtaacgttcggtaccggtttaacccgttaaggttttaaacggacgggtaacgggtacccgggggtaccccttaaggttaccgggtacggtttaccgaacggggtaccggtacgtaacgggttaacgggtaacgtccggaaacggggtaacgtaaacgggttaccgtttacccgtaaccgtttcccgtaaccctaacccgtaacggtaccgtaaccgggtaccgtaaaccgggttccccgttaacgggttaacccggtaacccggtttaaacggttaaaccgggtttttcgtttttaaacccgggtaaaccttttaaaaccgtttttaaccgtttaacccggttaaccgtttaaaacccttaaaacccgtttaaaaccgttttttaaaacccgttaaaaccccggttttaacccccttaacggttaaaaacccggttttaacgggttaaccccccgggtttaaccggggaaaccccggggttaaaacccggggtaaaccccgggtaaaaccgggggtttaaaaccgggaaaaaccccgggtttaaacggtaaaccccggtttaaacgggtttaacgggggacccgttaaacccgttaccgggtaaccccgtaaacccgttaccgggttttaaccttcccgggtttaccctttaaacccccgg

SEQ ID NO: 279564 - DNA, 554 bp, Homo sapiens
  misc_feature: GYAE6OF01EFEOK.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtcctagtttagagagtcggggccccagtcggaggttcagcggcagtggatcgagggacagtacgttcactctacaccgataccagcagccctgcagcctagaatatttgactaacttattactgtactaactactttaactaacttaccctataacgtaacgtccggttacgaccgtaacgggtacccaagggtaccggaaaccgaaggacccgtaacgtcggtacggcctagaccctaaccattccgtgttaccc

SEQ ID NO: 279565 - DNA, 634 bp, Homo sapiens
  misc_feature: GYAE6OF01E41YM.48.43.D10.1.454.CMB.1.raw
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttgacccagtctccatccctccctgtctgcatctggtgggagacagacgtccaccctcacttgccgggcaagtcaggcctatttccaatttctttacgcctggtatcagcagaaaccaggacaaactcctacactctgatctatgatgtccgtcctagtttagaggtaggtcggggccccagtccggtaggttcgaggcggcgaggtggatacgaagggactaggtacgttccacttcacaccatacgacgcacgtcctagtacgtcgtaagaagttactttagaacttaactttacttacctcgttaacaaacttaactttaaactaacctttaccctaacgtaacgttaaccggtcccggttaccggaacccgaaaccggggtacccgtaacggggtaaacgaaaacccgaacggtaccggtaaacgttgggtacgtaccgttacgaccaacccgtattccgttacgttccttaccc

SEQ ID NO: 279566 - DNA, 824 bp, Homo sapiens
  misc_feature: GYAE6OF01EGFBD.48.43.D10.1.454.CMB.1.raw
  modified_base (143)..(143): a, c, t, g, unknown or other
  misc_feature (143)..(143): n is a, c, g, or t
tcagagtatacatacacgaccggtgctcgatttagactagcagtaagggggcaggagtcagacccactcaggacacagcatggacatggacgggtccccgctcagctccgtggggcttctgctgctctggctcccgagggtcnccagatgtgtaccgtccagttcgaccctagtcctccactcctccctgtctgctattcgtggtgggacgacgaggactccgtacccctctaccgtccgggacccgggtactaacggtccgacggtacccttaacttttaccctaacttttcgttacgcccgtttaggtaactccgaacgaccgtaaacgaaaaccgaacggtaaccctaaaaccttcctaacctccgttaccgtacgtaactacctacgtacggtactcggtaaccgttacgttaagggttacgagggtcggtccgggaccctaggtcggtaggtcgagggtcggtacgtgggtacgtacgtacggaaacggacttaacgtacgtctaaccgtccgtaaccacccgttagtacccgaaggtcccacgttaccggtacaccggtactaaccggttaagtaacgttttaactttaccgaaccttttaacgttttacgtaaccttaaccgaaacttttaaacccgttaactttaaaccccgtaccctttaacccggtaattaacccggttaacgggtacccccgtttaaagggaaccccgggttaaacgggacccgttaaaagggttaacccgggaaaccgtaaccggacgtttaacgggccggtactacccgtacggtacaacgtacgtttcacccggtttacc

SEQ ID NO: 279567 - DNA, 559 bp, Homo sapiens
  misc_feature: GYAE6OF01ENU1P.48.43.D10.1.454.CMB.1.raw
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
tcagagtatacatacacgaccggtgctcgattttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctnacttgccgggcaagtcaggccatttccaattctttagcctggtatcagcagaaaccaggacaaactcctacactcctgatctatgactgcgtccagtttagagagnggggcccatcgaggttcagcggcagtggatcgagggacagagtcactcncacatcagcagcctagcagcctagaagtattttgactaactttattacgtagtactaactaactttaacaacttaaccctataactacggtacccgttcggaccgaaacgggtacccaagggtaacggaaacctaaggaccgtaaaccgttcggtacggccgttacgacctaaacccgtattccgtcggtttacc

SEQ ID NO: 279568 - DNA, 654 bp, Homo sapiens
  misc_feature: GYAE6OF01DECF2.48.43.D10.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
tcagagtatacatacacgaccggtgctcgatttagactagcagtaagggggcaggagtcagacccactcaggacacagcatggacatgagggtccccgctcagctccgtgggcttctgctgctctggctcccaggtcgccagatgtgacgtccagttcgacccagtcctccatcctcctgtctgcatctggtgggacacagagtccacccttnacgttgccggganaacgtcaggcctatttcctaactttcttagcctggtactcagacaagaaaccagaacctaaactcctaacacctactagtatctagtgatcgtccgtactaagtttacgaggtacggtccgggccctagtcggtacggttcagggccggcgtagggtaggacgtacggaacggggactaggtacggttacaccttcctaccgaactcgtacaacgtcgacgtaccgttgacgtacgtaccgtagtaaacgtttaccgtttagtacctttaagtttacttaccggttaactaaccctaaacctttaacgtttaaacctaacctttacccataaccgtaccgttccggttaacggaacccgtacgggacccgtaaggaaaccggaacgaagtaccgtaacgcggtagactccgacactacttctgttacc

SEQ ID NO: 279569 - DNA, 780 bp, Homo sapiens
  misc_feature: GYAE6OF01EXU4G.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgaccctagtctcctactcctccctcgtctcgcactctggtgggaggacagacgtcctaccctcctacgttcggtccgggacgaacgtacgacggacctactttaccttaactttactttacgtccgttcggtaactacgaacgaccgaacgaaaccgaacgaacctaaacctacctacctacctccgtagtacttactagtagtacgtacgtccgttaccgtaagtttaggagggtacggtccggggtaccccgtagttacggtacggttcgaacggcggtacggtagtcggtacgtacggaacgggtacacgggtacttcctaccgtacctacctaaccagttaccgacgacgaccgtcctcgtacgacgtaaccgtagtaacgtttagtttaccgtacgttaaacttttatttaaccgcgttaaacctaaacctttaaacctttaaccttaaaccgttacccctagtaacccggtacggttacccccggtagggaaccccggtaaaccgggaaaccggttaacgggtaaaccgggtaaacctaaacgggtacccggtaaccggttacggtacggacccgttaacgtaccctaaacccgttcgtttcgttccggttaacccc

SEQ ID NO: 279570 - DNA, 971 bp, Homo sapiens
  misc_feature: GYAE6OF01A9W3U.48.43.D10.1.454.CMB.1.raw
  modified_base (100)..(100): a, c, t, g, unknown or other
  misc_feature (100)..(100): n is a, c, g, or t
  modified_base (125)..(125): a, c, t, g, unknown or other
  misc_feature (125)..(125): n is a, c, g, or t
  modified_base (231)..(231): a, c, t, g, unknown or other
  misc_feature (231)..(231): n is a, c, g, or t
tcagagtatacatacacgaccggtgctcgatttagactagcagtaagggggcaggagtcagacccactcaggtacacagcatggacatgagggtccccgntcagctcctggggcttctgctgctntggctccgaggtgccagatgtgacgtccagttgacccagtctccatcctcctgtctgcatcgtgtggagacaggacgtccacccgttcaacgttgggcccgggtanaaacggttccgaacgggtccctaattttccccaaagttttccgtttaacggtcccgttagggttaattccgaaggtaccaaacggaaaacccgaagggtaacctaaaacccgttcccgtaacctaacccgtcccgttagtacttaccttaagtacgtaacgtcggtaccggttaccgtaaggttttaacggaacgggtacggtaccgggggtacccctaaggtttaccgggtaacggtttaccgaacgggtacccgggacgttaacggtacgggtaacgttaccggtaacgggggtaaccgtaaagggttacccggtttaacgtaaccccgtttacccgttaacccgtaaacccgtaagttaccccgtaaacgggtacccgtaacccgggtaccccgttacggaaccggttaaaccgggtacccgttaagggttaaaacgttttaccgttttaacggaacctttaaaccgttttacgtttaaccgttacgttaaacccgttaaaaccgttaaaccgttttaaaacccttaacccgtttaacccgtttaaccgttaaaccgttaaccgggtaccccgggtttaaccgggtacccggtaaaacccggggttaaacccggtaacgggttaaacccgggtaaaacccgtaaccgggttaacccggtaaacccggttacggttacccgggaccgttaccggaacccgttaaccgtaacccgttttcccggttcggtttaaccccg

SEQ ID NO: 279571 - DNA, 643 bp, Homo sapiens
  misc_feature: GYAE6OF01A7XEY.48.43.D10.1.454.CMB.1.raw
  modified_base (99)..(99): a, c, t, g, unknown or other
  misc_feature (99)..(99): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtgccagatgtgacgtccagttcgacccagtctaccatccctcctgtctgcatctgtggganacngagtccacctnacttgccggnaagtcaggctattccaattcttagctggtatcagacagaacnggacaactcacnctactgatctatgatcgtcgtactagtttagaagtaggtccgggtaccctagtccggtaaggttccaacgggtcggcgtagtcggtaacgtacgtaacggggtactaggtacggtttaccacttaccgtacctaaccgtactacccgtaggaccctaacggtcccgtacgacgtaccggaccttaaggtaaacgttacttttacgacttaaaccgttttacgtacgttaccgtactaacgtacgttacttaacgtaccgttaacccgttaccgttaacgtactttacggaaccggtacggtaaccgtaggtacggtacgaacgtaccgaaacgtacgtacgtagccgtacaccgtaacctatccgtacg

SEQ ID NO: 279572 - DNA, 738 bp, Homo sapiens
  misc_feature: GYAE6OF01CRP5B.48.43.D10.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
tcagagtatacatacacgaccggtgctcgatttagactagcagtaagggggcaggagtcagacccactcaggacacagcatggacatgagggtccccgctcagctccgtggggcttctgctgctctggctcccaggtgccagatgtgacgtccagttcgacccagtctccatccctccctgtctgcatcgtggtggganacagacgtccacctnacgttggccggganaagtcacggcctatttccaatttctttagccgtgtatcagcaacgaaaccacggaacaaactcctacactcctgtactctagtgtacgtcgtcgtaccgtaggtttaggacggtacggtccgggtacccctagtacggtacggtttcgaacgggtcggacgtagggtacggtacgtaggaaccccccgggtagtacggtaacgttacctaccgtacctaccgaacctaacgtaccgaacggacctaccggtcccgtacgaccgtaccggtaccgttacgtaacgtttacgttttacgtaacctttaaccgttttaactttaaccgttaacgtaaccttaaaccgttaacctttaaaccgttaacctttaaccctaactaacgttaacccggtacccggttaaccggaacccggtaaaccgggtaacccgtaacgggtaaccggtaaaccgtaacggaccggtaacgtacgggtacgtacgtacgactaccgtacttcgttcgtttacccg

SEQ ID NO: 279573 - DNA, 573 bp, Homo sapiens
  misc_feature: GYAE6OF01EBS8P.48.43.D10.1.454.CMB.1.raw
  modified_base (196)..(196): a, c, t, g, unknown or other
  misc_feature (196)..(196): n is a, c, g, or t
  modified_base (441)..(441): a, c, t, g, unknown or other
  misc_feature (441)..(441): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctggtggganacagagtccaccctcacttggccgggcaagtcaggcctatttccaattctttagcctggtatcagcagaaaccaggacaaactcctacactcctgatctatgatgcgtactagtttagaggaggtcggggcccagtcggaggttcgagcggcaggtggagtcgaggggacaggtagttcactctcaccatcacgcacgcctgacacgtccgtagaacgttatttacgacttaactttattacgtntacaactagtacttaacgtaacgttaaccccttcgtaaccgttacgtttcgggacccgtaaggggtaccgtaagggtacggaacgtacaacgaaacggtaacgtggtacgtactcgaccactcgtcgttacg

SEQ ID NO: 279574 - DNA, 610 bp, Homo sapiens
  misc_feature: GYAE6OF01C7RQF.48.43.D10.1.454.CMB.1.raw
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaagtcggccagacggtcgccctgaacctagacgcaagtgacgaccaagacaggacctaagtgggtgtgacgaccctgaggagcgtcggccgtggtcccaggcacgcgcgtcggccctgctgcgtgcgtggtcncggctagtcggccgccagtcgcgtgccgcgaccgccgtagtcggttcgaccgtaaccggacggaaccgggtcccgggaacccgacggtaccccgngggacctccgtacgtaggtacggaacgcgtaccgccgtactaccgacgtccgaggccggacgtcggtgggtacgggcgacggtcgacggacccgacggccgtcccgtccccggtactcctacctccgttcccgtacccccg

SEQ ID NO: 279575 - DNA, 603 bp, Homo sapiens
  misc_feature: GYAE6OF01DPX4R.48.43.D10.1.454.CMB.1.raw
  modified_base (588)..(588): a, c, t, g, unknown or other
  misc_feature (588)..(588): n is a, c, g, or t
tcagagtatacatacacgaccggtgctcgatttagactagcagtaagggggcaggagtcagacccactcaggacacagcatggacatggagggtcccccgctcagctccgtggggcttctgctgctctggcctcccaggtgccagatgtgacgtccagttcgacccagtcctccactcctccctgtctgcatcgtggtgggagacagagtccaccctcacgttgccgggacaagtcaggcctatttccaattctttagcctggtatcagcaagaaccagacaaactcctacactcctgatctatgatgcgtcctagtttagagtacgtcgggccctatcgaggttacaggcggcagtgagtacgagggacagtacgtcactctaccacatcgacgcacgctcgctacgccgtagaacgttgtttacgacgttaactttaacgttacctagtaaccctaaattaacctttaaactaaccgtttaaccctataacgttaaccgtccggttaccggaaccgtaacgggaacccgtagggtaaccgaaaaccgtaacggtacgtacgttcggtacggcgtacgaccaccctntcccgtcgttacccg

SEQ ID NO: 279576 - DNA, 656 bp, Homo sapiens
  misc_feature: GYAE6OF01DDG5O.48.43.D10.1.454.CMB.1.raw
  modified_base (213)..(213): a, c, t, g, unknown or other
  misc_feature (213)..(213): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (645)..(645): a, c, t, g, unknown or other
  misc_feature (645)..(645): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatcctccctgtctgcatctggtgggagacgagacgtccaccctnacttcgccgggacaagtcacggcctatttccaattctttagccctggtatcagctaacgaaactaggaaccaaaacctcctacgaccttcctagactactatgattcgcgtccaagtttaggagacggtcgggcccagtcgnggttcgaggcggacgnggtacggacgtacggaagggacgtacggtagtttacaccgttctaccgaccctacgtacacgacagtccctcgcacggccgtacgtaagtcttttacgctttaaactttacgttacttcgttaacctaaaccttaaccttttaaacgtaaacctttaccctaactaacgttaaccggtacccgttacgggaaccctaaccggggaaacccgtacgggaaaccggtaaaaccgacggaacggtacgttaggtacggcgtaacgacccaccgtacnttccgttaccg

SEQ ID NO: 279577 - DNA, 596 bp, Homo sapiens
  misc_feature: GYAE6OF01C5LDW.48.43.D10.1.454.CMB.1.raw
  modified_base (508)..(508): a, c, t, g, unknown or other
  misc_feature (508)..(508): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccggtcctccagggagcccatgctgcaagtcgggccagaggtgcccctgaacctgaaggccaatgagacccaagacagccaaagtgggtgtgagacccctgaggagctagggccctggtcccaggcagcgctggccctgctgcttgctgggtctgccatcggtacgccgagtggcctgcgtacgccgaccctaagtggttacgcaccggacgaaacggtccggggaccacggaccctggacgcctcgaggttggaacgtcgacgtccgatcccgagacccgtgacggacgtccncgggtcgggaccgagggtccacggtccccgaaacgggtcctaccggccccccgttacggtccctaacgttcccgtccgttccccccgg

SEQ ID NO: 279578 - DNA, 697 bp, Homo sapiens
  misc_feature: GYAE6OF01B91D4.48.43.D10.1.454.CMB.1.raw
tcagagtatacatacacgaccggtgctcgatttagactagcagtaagggggcaggagtcagacccactcaggacacagcatggacatgagggtccccgctcagctcgtggggcttctgctgctcgtggcctcccaggtgccagatggtgaccgtcctaggttcgaccctagtcctcctactccctcctgtctcgctatcgtggtaggagacgagtacgtaccaccctcgtacgttcggccggtacaacgtccgacggtcctactttacctaactttccgtttacgcgttaggtactacgacgtaccaaacggaaacctacggaaacctaacctaccgtaacctacctaccgtacgacttacgtacgtagtactccgtacgttacgtaagttacggacggtacggtccgggacccgtagtacgggtacgttacgagggtacgcggtaggtcggtacgtacggacgggtaaccgtaggtaccgttactaccgtacgtacctaaccgtacgtaccgacgtaccgtaccggtccgtacgaccgtacgtaccgtacgtacgttacgttacgtacgttaattacccccccccctagtactactaacgttaacttaactactacctactacgtacgtacgtacgtacgacgtaccgagtacgaacgagacgtacgacgtcgacgtacgtactactctcgtctac

SEQ ID NO: 279579 - DNA, 708 bp, Homo sapiens
  misc_feature: GYAE6OF01BTD2Q.48.43.D10.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
tcagagtatacatacacgaccggtgctcgatttagactagcagtaagggggcagggagtcagacccactcaggacacagcatggacatgagggtccccgctcagctcctggggcttctgctgctctggctcccaggtgccagatgtgacgtccagttgacccagtcctccactcctccctgtctgcatcgtgtggganacagagtcaccctcacgttggaccgggacaagtcaggcctatttccaattcttagcctggtactcagcaagaaccaggaacaaacgtccacactcctagtactctaangactcggacttccgtagtttaacgaggtacggtccgggaccctaggtcggtaacggttcgaacgggtccggacgtaggtcggaacgtcgaacggggactaggtacgttcaacccgttctaccgaacctactccgaactcgtacgtcccgtacgacgacgtacccgttaaggtaacgttagttttacgaccgttaacttttacgtttaacgttacgtaacgtaaacctttaaactttaaacctaaaccgtttaacccttacgtaaccgttaaccgggtacccggttaacccgggtaacccggaaaccggggtaccctaaacggggtaacggaaaacccgtaaggtaaccggtaacgtcgggttacggacgttcgacccgttacacgtttccgtacgtttaccc

SEQ ID NO: 279580 - DNA, 698 bp, Homo sapiens
  misc_feature: GYAE6OF01CA7U9.48.43.D10.1.454.CMB.1.raw
  modified_base (99)..(99): a, c, t, g, unknown or other
  misc_feature (99)..(99): n is a, c, g, or t
  modified_base (485)..(485): a, c, t, g, unknown or other
  misc_feature (485)..(485): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtgccagatgtgacgtccagttgacccagtctccatcctccctgtctgcatctggtgggagacagagtccacccttcaccgttggacccgggacaacggttcgacggtcctacgttttccaatttcctttaaggccttggtactcacgtacaacggtaaaccaggaaccaaaccgtcctaaccaccttcctaggtacttcctatcgtatcgtacgttacctaggttttagaggtacggtccgggaccccagttaccggacggtttacgacggcggcgtagggtcggacgtacgaacggggactaggtcgttacctacgtcctaccaccgtatacgacgtcacgtccgtacncgacctcgtagtaacgtttatttaccgaacttaaccgtttataccgttacgttacttaaaccttaaccgtttaaacctaacctttaacccctaagttaaccgttaccgtaccgggtacccgtaaccggaaccggtacccggtaaggtaaccgaaaccgtagggaaccttacggtacgtacggtcgtaacgacctacgtactcgttcgttaacc

SEQ ID NO: 279581 - DNA, 833 bp, Homo sapiens
  misc_feature: GYAE6OF01E2NSN.48.43.D10.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaagtggactggggtntactgtaacncgccctgctggcgaggacgggaccagggcctacccgtcctccgagggacgcccancgctggacgaacggtccgggaccaggacgggtccgtcccccgtaggaaaccctggaacggacccgtaagtacggaaccgaacccgaagaccgaacgggaccgtaaggttggggttcggtacggaaccggaccccggtagacggggacgtaccggtccgggggtcccctacggggtccccgaggtacccgacggccggtcccgtccgggtcccccgtcggtaccgtcgggcccgttggggtccgttcggggtttcccgtaccgggtaccggtacggtttccggtaccccggtaccccggtagggttcccgggttcccgtccggggtaccgtcccgggtaccgtaaccccggtaacggttcggggttccccgaaccggtaacccgaacggggtaaacccggggtcccgggaaccccgtacgggtacccccggtggaccgttacccggtaccgtagggtaccggaagaccgtcggaccgttacgccgtagccggtacggcgtccggacggtggacgggccgtacgggtaccacggtcccggacgccccgtacccggtacccgtcgtaccgtcccgttcccgtcccgttcccccg

SEQ ID NO: 279582 - DNA, 794 bp, Homo sapiens
  misc_feature: GYAE6OF01ELJ48.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggcctcccaggtgccagatgtgacgtccagttcgacccagtcctccatccctccctgtctgcatctggtgggagacagacgtccaccctctaccgttggcccggggactaacggtccgacgggtacctaacttttacctaacttttaccttttaacggcccttagggttaacttccgaaggtaccgaaacggaaaacccgaacgggtaaaccctaaaaccttcccctaaacccgtacccttaccctttacggtaactttccgttaagtacggtaactttccgggtaccgttttaaccgttaaacgggtttttaacggaaggggttaccggggttacccgggggtaacccccgtaagttaccgggggtaacgggttttaccggaacgggcccggggtaaccgtagggtcggtaaacgtacgggaacgggggtacgtaacggttaccgttaaccgtaccgttaccttacccgacctacgtacgacggtacacgtcgcgtacctcggacgttagtaacgttatttacgtaacttaactttcttacgtactaacctaactttaaccttaactaccttaaccactaacgtacgtacccgtacggaccgtaaccggtaccgaaggtaaccgaacgacgacgaagtcggtagcttacgactactcttcgtgttccc

SEQ ID NO: 279583 - DNA, 867 bp, Homo sapiens
  misc_feature: GYAE6OF01CIS50.48.43.D10.1.454.CMB.1.raw
tcagagtatacatacacgaccggtgctcgatttagactagcagtaagggggcaggagtcagacccactcaggacacagcatggacatggacgggtcccccgctcagcctccgtggggcttctgctgcctcgtcggcctcccgaggtcgccagatggtgaccgtccagttcgaccctagtcctcctactccctccctgtctgctatcgtggtagggacacgagtactccaccctctacgtcggccggacaacgtccgacggtacctactttacgtaacttttccgtttacgccgttaggttactcgaacgacgaaacgaaaccgacgaacctaacctacctactacctcctagtactctatctacgtcgtccttacgtaagttacggacgtacggtcccgggccctaggtaccggtcggtacgacggtcggacgtaggtaggaacgtacggaacggtacgtacggtacgttacccgtaccttaccgtaccgtaaccgttaacgaccgtaaccgggaccgtaccgtacccgttaccggaccgtaacggttacccggttaagttaaaccggttttacgtttaacgtaaacccttttaacgttttaaacgttaacccgttaacctttaaacgtttaaaccctttaaaaccttttaaacccgtaaacccctttaacgttaaccgtaaccgtttaaccccggggttaccgttaaccccgggaaacccggttaaacccggggaaaccccgggttacggtaaaaaccccgggaaaaccggttaaccggttaacggttaaacggggttccccgtaacggggttacccaaccgggttaccctaccggtttaacgtttcccgttaccggtttaacccc

SEQ ID NO: 279584 - DNA, 853 bp, Homo sapiens
  misc_feature: GYAE6OF01ELMDI.48.43.D10.1.454.CMB.1.raw
  modified_base (139)..(139): a, c, t, g, unknown or other
  misc_feature (139)..(139): n is a, c, g, or t
  modified_base (165)..(165): a, c, t, g, unknown or other
  misc_feature (165)..(165): n is a, c, g, or t
  modified_base (201)..(201): a, c, t, g, unknown or other
  misc_feature (201)..(201): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccgaggtcnccagatgtgacgtccagttcgacccngtctccactccctcctgtctgctatcgtggtagganacagtacgtcccaccctcgtacgtcggaccgggactaacggtccgacggtacctacttttacctaacttttcgtttacgccgttaggtaactccgaacgtaaccgaaacggaaaaccgtaacggaacctaaaacccttcccctaaccgtacccgttaccgtagtaaccgttacttaacggtcgtaacgttccggtaccgtttaacgttaaggtttaacgggaacggttccgggtacccgggacccctaaggtccggtaacggtcgacggtacggacgtagggtacgaacgtacggaacggtaacgtaacggttacttacctaccgttaccgacccgtaactaacgtaccgacggtacctaccggtccgtacgaccgtaccgtaccgttaacgttaacgtttaccgtttacgtaaacccttaacgttttacgttaaccttacgttaaaccgttaacctttaaacctttaaacccgttaaccctttaacccgtaacttaaacccggttaccgttaccccgggtaaccggtaaacccggaacgggttaacccggtaaaccggtaaaccgggtaaacccgtacgggtaaccgttaccgggtcgtaccggtaccgtaccggtaacccgtaccgtaccttccggtttgttaacccccg

SEQ ID NO: 279585 - DNA, 837 bp, Homo sapiens
  misc_feature: GYAE6OF01AVK7B.48.43.D10.1.454.CMB.1.raw
  modified_base (99)..(99): a, c, t, g, unknown or other
  misc_feature (99)..(99): n is a, c, g, or t
  modified_base (137)..(137): a, c, t, g, unknown or other
  misc_feature (137)..(137): n is a, c, g, or t
  modified_base (193)..(193): a, c, t, g, unknown or other
  misc_feature (193)..(193): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtnccagatgtgacgtccagttgacccagtctcatcctcctgtctgcatcgtgtggganacagacgtcacctcacgttcggccgggcaagtcacggtcctatttccaagtttcttaggccttggtactacgagtaccaagaaaaccgaggaaccaaaaccttccgtaacaaccttccctagtaacttccgtaatagtacgttcggaccgtttaccgtagggttttaacgacgggtacggtccggggacccctagttccggtaggttccgaggcggacgtaggtacggacgtcggaacgggtacgtaggttacgttaccgtaccttaccgtaaccctaaccgtaacgttaccgaacggtccgtaacgtcccgtacgaccgtacggtacccgttaggtaaacggttactttttaaccgaaccgtttaaaccgtttaacgtttaaccgtttactaaaacccggtttaaacttaaaccctttttaacccgtaaaccgttttaaccccgtaacgtttaaaccggttaaaccggttaccccggggttaacccggaaaacccggggttaaacccgggtaaacccgggtaaaccggggttaaaccgaaaaaacccgggtaaaccgttaccgggtaaacccggtaggttaacccggggtaccgtcccggtaaaacccgttacccgttaacctttcgttaccgtttaaccccg

SEQ ID NO: 279586 - DNA, 621 bp, Homo sapiens
  misc_feature: GYAE6OF01AFR4Y.48.43.D10.1.454.CMB.1.raw
  modified_base (99)..(99): a, c, t, g, unknown or other
  misc_feature (99)..(99): n is a, c, g, or t
  modified_base (615)..(615): a, c, t, g, unknown or other
  misc_feature (615)..(615): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtgccagatgtgacgtccagttgacccagtctccatcctccctgtctgcatctgtgggagacagacgtcaccctcacgttggccgggcaagtcaggcctatttccaatttcttagcctggtatcaagcaagaaccaggaacaacctcctacacctctgatctatgatcgcgtcctagtttaggacgtacggtcgggacccctagtaccggtacggttccgagggccggacgtaggtcggagtcgaaggggactaaggtacgttcgtacctcgtaccaccgtactcacgacacggtacctgaccacgtaccgtagtaagttacgtttgaacttaactttacttacttactaacgtaaccttaaccgttaactaaccgttaaccctataacgtaacgtccgttaccggaccgtacggtaacccgaaggtacggaaaccgtagtacggtacgttcggtacggcctacgtcaccgtacttccgtnttaccc

SEQ ID NO: 279587 - DNA, 793 bp, Homo sapiens
  misc_feature: GYAE6OF01CH1ZZ.48.43.D10.1.454.CMB.1.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
tcagagtatacatacacgaccggtgctcgatttagactagcagtaagggggcaggagtcagacccactcaggacacagcatggacatgagggtcccccgctcagctccgtggggcttctgctgctctggcctcccgaggtgccaagatgtagaccgttccaagttcgaccctagtcctccacttccctcctgtctgctagtcgtggtaggganacagacgtaccaccctctagttcgaccgggnaacgtcacggcctattactaattcttacgcgtagtactacacgacaacgaaacgacgaactaacncctaacnctacngacttcangactcggtactcgtaagttaggacgtacggtccggacctacgtacggtacgtcgacggcgacgtaggtacgagtacgaagggtacgtacgttacgttaccacgtttaccaccgtaacaccgttaacgacgtacccggtaacctcgtacgaacccgacgttacgtaaccggttaaggttttaacctttacgtaaacctttaaaccgtttacgtttaaaccttaccgtttaaaccctaaaaacccgttttaaacctttaaacccgttaaaccccgtttaaccccgttaacgttaaacccgttaacccgggttaccccggtttaaccggggtaaacccccggttaaacggaaaacccggggttaaccggaaaaccgtaaaaccccgggtaaacgaaacccggttaaggtaccgggtacgtcccgttaaacggaacctaaacccgttttacgtccgttcgttaacccc

SEQ ID NO: 279588 - DNA, 772 bp, Homo sapiens
  misc_feature: GYAE6OF01DAK5R.48.43.D10.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
tcagagtatacatacacgaccggtgctcgatttagactagcagtaagggggcaggagtcagacccactcaggacacagcatggacatgacgggtccccgctcagctccgtggggcttctgctgctctggctcccaggtgccagatgtgacgtcagttcgacccagtctccatcctccctgtctgctatcgtggtgggagacagacgtccaccctnacgtggccgganagtcacggcctattcattcttagctgtactcacgacaacgaaaccagaacctaactcctacactaccgtagtacttacgtatggtactcgtaccgtacgtaagtttacggacgggtacggtaccggggacccctaggttaccggtacggttacgacgggacggtacgtaagggtacgggtaacgtaccgggaaggggtaccgtaacgggttacgtttacccgtaaccgttaccctaacccgaaccttacgtacccgtaacggtaccgtaaccggtcccgtacggtaaccgtaacggtccgtttaagggtaaacgttttacgtttaccgtaaactttaaaccgtttttaactttaacctacgttaaccttaaaccgtttaaccttttaaaaccctaacctttacccgtaacttaacgttaacccgggttacccggtaaccgggaaccggtaaacccggggtacccggtaaacgggtaaaccgaaacccggaagtaccggtaagttaccgggtacgaccctacgactacctatccggttattacccg

SEQ ID NO: 279589 - DNA, 904 bp, Homo sapiens
  misc_feature: GYAE6OF01BT1VR.48.43.D10.1.454.CMB.1.raw
  modified_base (98)..(98): a, c, t, g, unknown or other
  misc_feature (98)..(98): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagagtatacatacacgaccggtgctcgatttagactagcagtaagggggcaggagtcagacccactcaggacacagcatggacatgagggtccccntcagctccgtggggcttctgctgctctggcctcccgaggtcgccagatgtgacgtccagttcgaccctagtcctcctactccctccctgtcctgctnttcgtggtgggaanacagacgtccaaccctnacgttcggccgggtacaacggtccgacggtccttaactttacctaatttaccgtttacgaccgttaggtaactacaacggtaccgaaacgaaaaccgaaggtaaaccctaaaacccttaccctaacctacccgttaccgtagtaacctaccttaagcgtaacgttcggtacgttaccgtaaggtttacggaacggtcgggtaccgggtaccctaggtacggtaccggtacgacgggccggtacgacggttacgggaacgtacggaacgggtaacgtaacggttacgttacccgactttacccgacctaaccgtacgtacccggaaacggtccccgaacggttccccgttaacgggaaccccgtacggttaacccggttaaggttaaaaccgttttacggtttaaccttaaacggtttaacctttttaaacttacccggtttaaccgtaaaaccttaaaccttttaaacccggtttaaacccaaccggttttaaccctaaacggttaacccgttaacccgggtttacccggtaaaccccggggtaaacccggtaaaaccggggtaccccggttaaaagggtaaacccggtaaaaccggtaccgggtaacccgttaacgggtacgggttccgaaccggttaccgacccggttaaactcgtcccggtttaatttacccccg

SEQ ID NO: 279590 - DNA, 823 bp, Homo sapiens
  misc_feature: GYAE6OF01CLVDQ.48.43.D10.1.454.CMB.1.raw
  modified_base (143)..(143): a, c, t, g, unknown or other
  misc_feature (143)..(143): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtcgccagntgtgacgtccagttcgaccagtctccatcccgtcctgtctgcatcgtggngganacagactcacctnacgttcgcgganagtcaggcctatttccaatttcttacgcctaggtactcagacaacgaaaccaggaactaacctctactaacctccgatacttctatagacttcgtaccgttacgtagtttaacggacggtacgggtaccggggacccctaggttaccggtaacggttacgaacggggtccggaaccggtaaggggttcggtaaacggtacgggaaacgggggtaaccgtaaacggggtttaaccgtttacggtaaacccttccggttaacccgtaacccaacgtttaccgggaaccgtacccggttaaaccgccccgtttaacggacccgtaaccgggtacgtttaaccgggttaaaggtttactttaaccggttaacctttaaaccgttttaacgtttaaccgttaacggttaaacccttaaaaccgtttaaacccgttttaaaccttaaaacccgttaacccgttaaaccgaacggtttaaccccggtacccggggtttaaaccgaacccgggttaaaccgggacccgggtaaacggttaaacccggaaacgtaacggtacccggtagtcggtaacgtcgtacgaaccctacgtctccgttcgttaccc

SEQ ID NO: 279591 - DNA, 645 bp, Homo sapiens
  misc_feature: GYAE6OF01EUR7E.48.43.D10.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
tcagagtatacatacacgaccggtgctcgatttagactagcagtaagggggcaggagtcagacccactcaggacacagcatggacatgagggtccccgctcagctcctggggctcctgctgctctggctcccaggtgccagatgtgccatccagttgacccagtctccatccttccctgtctgcatctgtagganacagntctccatcacttggccggcagtcgaggcattagtagttatttagccttggttcagcaagaaaccgaggaaacncccctaaactcctagactctacgcncgacactcctacttgactacgtacggtcgggtcctcgtacggtcgaggcggcgacgcggtatcggtggactacgtactttccactccgtaccaccgtatacctacgacgtacgtccgtagaccgacgtacgtaagaagttgttacgttacgaacttaactttaacgttacgtacgtaactaacgtaacgttaccgtttaacggtaacccttaacccgtttaccgttacctttaacggtttccgggaaccgggaaccggggttaacgtaagggttacggaaacgttaacgtaaaccggaaaccggttacgttcggtacggtacctacgaacctacttcgtcgtttccg

SEQ ID NO: 279592 - DNA, 715 bp, Homo sapiens
  misc_feature: GYAE6OF01B4OA4.48.43.D10.1.454.CMB.1.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctcctgtctgcatctgtggganacagagtcacccttnacttggccggcaagtcaaggccatttccaattctttagctggtatcagcagaaaccaggaacaaactcctacacctcctgactactatgaatcgtacgtcctagtttagaggtacggtacgggcccctagtaccggtaggttaccgaggacggtcgtaacggtggacgtacgacggggacagtacgtttacactacttaccaaccgactacgtacgacacgtaccgtacaccgtacgtccgtagtaacgttaattttacgaacctaacgttttaattaacgttacgttaacaaaaccttaacgttttaaacctaaacgtttacccctacgttaaacgttaaaccggtacccggtttaccggaacccggtaaaaccggggtaacccgtaaacgggggttaaccggaaaaacccggtaaccgggtaaacccggttaaaccggtacggttaacgggtaccccgtacgggtaacccaaacccgttaaccgttacggttacccgtttaaccg

SEQ ID NO: 279593 - DNA, 999 bp, Homo sapiens
  misc_feature: GYAE6OF01AIKW2.48.43.D10.1.454.CMB.1.raw
tcagagtatacatacacgaccggtgctcgatttagactagcagtaagggggcaggagtcagacccactcaggacacagcatggacatggagggtccccgctcagcctccgtggggcttctgctgctctcggcctcccgagggtcgccagtattgtacggaccgttacctaggttaccgaccccgtacgttccctacccaccttccccttcccctcggttccttcggacctacttcgttacgggtggggaacgaacgacggtaccgttaccctaacccccgttacgtaccggtttacgggaccccggggtaactaaccggttaccggaccggtaccctttaccttttaaccttaacgtttttccttaacggtacccggttgttaacctaccggtaacgacccgaaaacggtaaaacccgaaccggtaaaccctaaaccgttaacccctaaccctaaccgttcccggttaacggtaccttaacgtaaccgtacggttacgtccggtaccgttaccggttaagggttaacggacggggttaccgggtccccgggtaccgttacggtaccggttacgggtacgaaccgggacgggtacggtacgggtacggtacggtaaccggaacgggttaacgtacggttaccttacccggtccctttaccgaaccgtaccgtactaccggacgtaccgtccgtacccggacgtaccgtaccggtacgtaacggtttaaccgtttacgtttaaacccgttacgttaaaccgttttaaccgtttaacctaacctttaacctaaacccgttttaacccttaaacctttaacccgttaaccgtaacccggtttaaccgggttaacccggtaccccggttaacccgggaaacccggtaacccgggtaaccggtaaaccgggtaaaccggtaaccggtaacgaaccggggttacgccgggttaaccgacggtaaaccgtacccgtaaacgtttccggttaaccgttcgttaccccg

SEQ ID NO: 279594 - DNA, 745 bp, Homo sapiens
  misc_feature: GYAE6OF01EMC34.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccgaggtgccagatggtgacgtccagttgacccagtctccatcctccctgtctgcatctggtggagacagagtccaccctcacgttcggccgggactaaggtcacggccttatttacccaagtttctttacgccgttggtacttcgagtacaacgaaaaccgacggaaccaaacctacctaactacctcctagacttctatgactcgcgttcctaggtttagaggacggttccgggaccctacgtcggtaacggttccgaagggtccggtacgaggttggaacgtacgaagggtaccgagtacggttactacctactacgaacacttcgagtaccgaggtccctaggaccgaacggtacccgtaagtaacggtttaacgttttacgacctttaaactttacgtttacctaggttaaccctaactttaaacctttaaacccttaacctttaacccgttaacgttaacgttaacccgggtcccggtttaacccgggacccggtaaaacccgggtaccccggtaaagggtaaacccggtaaaaccgtaacggtaaccggtaaccgttaggtcgggtaaaccgtaccgtacctacccgtaacgttcgttaccgttaccc

SEQ ID NO: 279595 - DNA, 539 bp, Homo sapiens
  misc_feature: GYAE6OF01A064P.48.43.D10.1.454.CMB.1.raw
  modified_base (363)..(363): a, c, t, g, unknown or other
  misc_feature (363)..(363): n is a, c, g, or t
tcagagtatacatacacgaccggtgctcgatttagactagcagtaagggggcaggagtcagacccactcaggacacagcatggacatgagggtcccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctgtatcagcagaaccagacaactcctacactcctgatctatgagtgacgtcagtttagagagtcgggcccagtcgaggttcagcgcagtggatcagggacagagttcactctcacnctcagcacgcctgcagcctagagtattgactacttattactgtactaacctactttaaccaacttaccctacacgttaacgaccggttccggaccgacgggaacccgaagggttaccggaaaccaacggaccggtaactacggttgtacgttcccacgtaactcttcgttccttcc

SEQ ID NO: 279596 - DNA, 724 bp, Homo sapiens
  misc_feature: GYAE6OF01EAQOL.48.43.D10.1.454.CMB.1.raw
tcagagtatacatacacgaccggtgctcgatttagactagcagtaagggggcaggagtcagacccactcaggacacagcatggacatgagggtccccgctcagctccgtggggcttctgctgctcgtcggctcccgaggtcgccagatggtcgaccgtccgagttcgacccagtcctccactccctccctgtctgctatcgtgggtgggacgacaggactcctaccctcgtaccgttcggccggacaacggtccacggtcctactttacctatttccttacgcctggtactcgagacaacgaaccgagacctaaactcctactacctcagtactcgtagtcgagtcgcgtacgtagttaggcgggtacggtcccgggtacccaggtacggtacggttacgcggacggtacgtaggtaggaacgtaggaacgggtatacgttaacgtcctaaccgtcctaaccctacgacttacccgggaacgtacccggtacgtacccgtagtacccgtaacggtaaccgtttaaggttaacgtttcgttaaccgtactttaacgttttactacgttacgtaacctaacccgtttaaacttaaacctacgttaccgttaactaacgttaacccggtccgtaacgggtaccgaaaccgggttaccaggtaaaccgaacgtaacggtacggtagtcgtaccgacggtacaccgtacgttacctttgccgtttaccg

SEQ ID NO: 279597 - DNA, 787 bp, Homo sapiens
  misc_feature: GYAE6OF01ASOPC.48.43.D10.1.454.CMB.1.raw
  modified_base (124)..(124): a, c, t, g, unknown or other
  misc_feature (124)..(124): n is a, c, g, or t
  modified_base (137)..(137): a, c, t, g, unknown or other
  misc_feature (137)..(137): n is a, c, g, or t
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (495)..(495): a, c, t, g, unknown or other
  misc_feature (495)..(495): n is a, c, g, or t
  modified_base (648)..(648): a, c, t, g, unknown or other
  misc_feature (648)..(648): n is a, c, g, or t
tcagagtatacatacacgaccggtgctcgatttagactagcagtaagggggcaggagtcagacccactcaggacacagcatggacatgagggtccccgctcagctccgtgggcttctgctgctntggctcccaggtnccagatgtgacgtccgagttcgacccagtctccatcctccctgtactgnatcgtgtggagacaggtntccaccctnacgttgcccggtanaacggtcacggtcctaatttccaatttcgtttacgccgttagttacncgagaaccgaagaaccgaacggaacctaaaccttcccgtaactacccttacgtacgtaacttctaacgtcgtacgtcgtacccgttagtaacgggtttagaacgggttcgggtaccccgggtaaccctacgggttaccggtaaacgggttccgaacgggtacgtcccggtaaggtaccgggtatacgggaaccggtaagtaccgggtactcccacgttacncctaacgctaccggacgtccgtaaccgaccgtacgtacgtaaccgtacggttaaccgttaagttaacgtttacgtaaacctttaccgtttaacgttacgtaaccttaacctaaaccgtttaaaccttaaaacccgttaccttaaaccccgttntaaaaccggttacccggtttacccggaacccgtaaccggaaccggtaacccggaacggtaaaccgtaaaaccgacggtaccgttaaacgaccgttaacgggtccctaagtaccccgtatacggtttcctcccgttaacg

SEQ ID NO: 279598 - DNA, 1200 bp, Homo sapiens
  misc_feature: GYAE6OF01CA1S9.48.43.D10.1.454.CMB.1.raw
  modified_base (99)..(99): a, c, t, g, unknown or other
  misc_feature (99)..(99): n is a, c, g, or t
  modified_base (205)..(205): a, c, t, g, unknown or other
  misc_feature (205)..(205): n is a, c, g, or t
  modified_base (328)..(328): a, c, t, g, unknown or other
  misc_feature (328)..(328): n is a, c, g, or t
tcagagtatacatacacgaccggtgctcgatttagactagcagtaagggggcaggagtcagacccactcaggacacagcatggacatgagggtccccgntcagctccgtgggcttctgctgctctggctcccgaggtgccagatggtgaccgtccaggttcgacccagtcctccactccctcccgtgtctgcatcgtggtggganacgagctccacctcgtacgtcggccggacagcgacggtcctactttcctaatttcttacgtccgtaggtactacgagtacaacgaaccgaacgtaacctaaacctcctaaccacttaccgtanacttcgtaatcgacgtacgtaccgttaccgttaagggtttaacggacggttaccggggtaccgggtacccccgtaggtttaccgggtacggttaccggacgggtaccggtacggtaacggttcggggtaaacggttaccgggaaacggggtacccggttaaacgggtttaaccgtttacccccgtaacccgtttaccccggtaacccccgtaaaccggttacccgttaacccggtaacgggtaacccccgttaacccgggttaaccccgggtaaccgtaacccgggttaaacccggttaccccgggtttaaacggtttaacgggtttttaaccgtttttaaccccgggttaaaacccgttttttaaacccccggttttttaaaccgggtttttaacccggttttaaaaccccgtttaaaaccccccggttttttaaaaaaccccgtttttaaaaccccccggttttttttaaaaaaaaacccccccgttttttaaaaccccccccgggtttttttaaaaacccccccggtttttaaaaaccccggggtttttaaaaaccccggggggtttttaaaaccccccccgggggttttaaccccccggggggttttaaaaaccccccgggggtttaaaaccccccggggggtaaaaaccccccggggggtttaaaaaacccccccggggggtttaaaaaaacccccggggggggggggttttaaaaaaaaaaccccccccgggggttaaaaaaaaacccccccgggggttttttaaaaaacccccccgggggggggttaaaaaaaccccccccgggggttttttttaaacccggggggggttaaaaaacccccccgggggggttttttaaacccccc

SEQ ID NO: 279599 - DNA, 522 bp, Homo sapiens
  misc_feature: GYAE6OF01BNN5L.48.43.D10.1.454.CMB.1.raw
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (517)..(517): a, c, t, g, unknown or other
  misc_feature (517)..(517): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagagtccaccctcacttgccgggcaagtcaggccatttccaattctttagcctggtatcagcaagaaaccaggacaaactcctacactcctgatctntgatgctcctagtttagagaggtcgggaccccagtcgaggttcaggcggcaggtggatcgagggacagagttcactctcacatcagcagcctgcagcctagaagtatttcgactaactttntactntactaactactttaacaactttaccctataatacgtccgttacggaccgtaacggccaggtacgaacagacgacgtagtcgacgtcgacacactgtntaccg

SEQ ID NO: 279600 - DNA, 932 bp, Homo sapiens
  misc_feature: GYAE6OF01CBKFZ.48.43.D10.1.454.CMB.1.raw
  modified_base (99)..(99): a, c, t, g, unknown or other
  misc_feature (99)..(99): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtcgccagatgtgacgtccagttcgacccagtctccatccctccctgtctgctatctggtagggacacagacgttccaccctctaccgttcggcccgggtacaaacggtccgacggtccctaacttttaccctaaactttttccgttttaacggtcccgttagggttaacttacccgtaaaaaccgaaaacggtaaaaaccccgtaacggggaaaacccttaaaaaccttacccccgttaaacctaaccccttacccgttacgggtaaacctttacccggttaattcggtaacgtttccgggtaacccggtttaacccgtaaacggggtttttaacgggaacggggtaaacggggttcccggggggtacccccctaagggtttcccggtaaacgggggtttccgaacggggtccggtacgtaacggggttcgggaaccgttacgggtacggggggaacctaacggggttaccgtttcctaaccgttccctaccctaacccgtaacttacccggaaccggtccgtaacccgtaccgttcgaaccgtaccggtaaccttagggtaaacgtttaccgttttacaaaccctttaacgtttaactttacgttaacgttaacctaaacttttaaccgtttaaaccttaaaccgtttaaccccttaagtaaccgttaacccggttacccggttaccggaaccggtaaccgggtaacccgaacgggtaaacggaaacccgtacggtacgtaaacgttcgggtaacgtacgacgtacccgaacttattcccgttgtacctttacccg

SEQ ID NO: 279601 - DNA, 807 bp, Homo sapiens
  misc_feature: GYAE6OF01BSUZ6.48.43.D10.1.454.CMB.1.raw
  modified_base (795)..(795): a, c, t, g, unknown or other
  misc_feature (795)..(795): n is a, c, g, or t
tcagagtatacatacacgaccggtgctcgatttagactagcagtaaggggggcagggagtcagacccactcaggacacagcatggacatggacgggtccccgctcagcctccgtggggcttctgctgctcgtcggcctcccgaggtcgccagatggtacgaccgtccgtacgttaccggacctacgtccttacctctccccttcccgttgtctcgtctacgttccggtaggtacggggacgacggacgtaccgtaccctaacccttaccgtaccgttcgggcccggtacgtaacggtccgaaccggtcccttacttttacccgtaacgttttaccggttacgtacggttacggttactacgaaccggtaccgaaacgtaaaaccggaacgtaaacccctaaacctacccgtaaccgtacccttaccgtacgtacgtcttaacgtacgacgtcggtaccgttacggtaaggttagggacgggtaacgggtccggtaaccgtcggtaacggtcggtacggcgggacgtacgtagggtacgtaggacgaacggtgtacgtactccgtacctcacgacgtacacgtacacgtctaccgtacgtacggtaccttacgtacgttactttacgttaaccgtttaatacgtttaacttaccgtaacttaacctaaccgtttaactaacccgttacgttaacctaccgttaactaccgtaccggtaccgaaaccgggtacgtacccggtaacggaccgaaacgtacggtacggtacggtactaccggacgtaccacgtaccgtnttccgtcttccg

SEQ ID NO: 279602 - DNA, 799 bp, Homo sapiens
  misc_feature: GYAE6OF01DGNRO.48.43.D10.1.454.CMB.1.raw
  modified_base (773)..(773): a, c, t, g, unknown or other
  misc_feature (773)..(773): n is a, c, g, or t
  modified_base (785)..(785): a, c, t, g, unknown or other
  misc_feature (785)..(785): n is a, c, g, or t
tcagagtatacatacacgaccggtgctcgatttagactagcagtaagggggcagggagtcagacccactcaggacacagcatggacatgacgggtccccgctcagctccgtggggcttctgctgctcgtggcctcccgaggtcgccagtatggtcgaccggtcctaggttacgaccctagtcctcctacttccctcccttgtctgcctattcggtggtacgggaacgacaggtactaccctaccccgttctaccggttccgggcccggggaactaacggttaccgaaccgggttaccctttaacgttttaaccttaacgttttccgttttaccggtcccgtttagggtactaccgaaccggtaaccgaaaaccgaaaaccggacgtaaaaccctaaacctaccctaactcccgttaccgtacggtacttacgtagtacgtacgttaccggtaccgtttaccgtaaagggtttacggaacggggtccgggttaccccggggacccttaaggtaacggttcgggtaaccgacggggtacccggaggttacgggtacggtaacgacggtaaacggggacgttacgtaccggttacctacctaccctacaaccgactacgacgacgtacgacgtcgaacgtacgtacgtagttagttactttacgactttaacttactacgtactaactaacttaacttaactaaccttactacgttaacgtacgtccggtaacgacccggtaacgaccgtagtaacgaaaccgagacgtagtacgnggactcgtaacnttactgttccgtac

SEQ ID NO: 279603 - DNA, 870 bp, Homo sapiens
  misc_feature: GYAE6OF01B6KY2.48.43.D10.1.454.CMB.1.raw
  modified_base (99)..(99): a, c, t, g, unknown or other
  misc_feature (99)..(99): n is a, c, g, or t
  modified_base (115)..(115): a, c, t, g, unknown or other
  misc_feature (115)..(115): n is a, c, g, or t
  modified_base (304)..(304): a, c, t, g, unknown or other
  misc_feature (304)..(304): n is a, c, g, or t
tcagagtatacatacacgaccggtgctcgatttagactagcagtaagggggcaggacgtcagacccactcaggacacagcatggacatgagggtccccntcagctctgggcttcngctgctctggctccgaggtcaccagtatcgtcgactccagttacgaccctagtcctccagttccctaccctgtctagctattcgtagtggactacagccgtacctcccgtacgtacgtcggtcccggactaacggtccacggtaccttaactttaccggtaattttccgttaacgtccgttaggttacnccgtaacgacgaacgaaaccgtacgggaacctaaaccgttaccctaccgtacttacccgtagttacgtacgttacgtaacgtagttaccgtaccgttacccggttaagttttaaccggaggttaacccggtacccgggacccgttaacggtaaccgggttaccggttacgggtaaccggtccggggttaaccgtaagggttacccgggtacgttaccggaaacggggtaccgtaacggttaacccggtttaccacccggttaccgaccggttaacctacgtaaccgacgtacccggacccggtacccgtaaccgtacggtaccgttaagtaaggtttccgtttaacgaaaccgttttcgtaaacttcccgtaacggtaacctttaaactaccgttttaaacgaccctttaaccgtaaccggtacttaaaccccgggtccggttaacccgaccgggtaaaacccgggtacggttaaccggtaaacccggaagtaccggtaacgtaccggtaggttccgaacgtccctaacttcccggtaacgttccggttacgttaccctaacccgg

SEQ ID NO: 279604 - DNA, 544 bp, Homo sapiens
  misc_feature: GYAE6OF02IEKK8.48.43.D10.1.454.CMB.1.raw
  modified_base (431)..(431): a, c, t, g, unknown or other
  misc_feature (431)..(431): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaaatgagacccaagacaggccaagtgggttgtgagacccctgaggagctgggccctggtcccaggcagcgctggcccctgctgctgctggtctggccagtggtcgcccatggcctgctgcgcccaatcggttgcaccgcaacgcgggacccagacccnggacgcctcagttgaagcgagccgatccagcctgccgagccgtgtcggggcgagggtccacggcccgaaggccgtcggcccccgtcggtcctaccgttccgtcgttcccccgg

SEQ ID NO: 279605 - DNA, 510 bp, Homo sapiens
  misc_feature: GYAE6OF02I6QUN.48.43.D10.1.454.CMB.1.raw
  modified_base (393)..(393): a, c, t, g, unknown or other
  misc_feature (393)..(393): n is a, c, g, or t
tcagagtatacatacacgaccggtgctcgatttagactagcagtaagggggcaggagtcagacccactcaggacacagcatggacatgagggtccccgctcggctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcgagggacagagttcactctcaccatcagcagcctgcagcctgaaagtnttttgctaacttattactgtacaactactttaacaactttaccctcattaacgcccgttacggaccaagggacccaggtaggaaacccaagcgaactgtggctgcaccatctgtctc

SEQ ID NO: 279606 - DNA, 546 bp, Homo sapiens
  misc_feature: GYAE6OF02GEZ9M.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggcccatcgaggttcagcggcagtggatcagggacaggagttcgactctcaccatcagcagcctgcagcctgaagattttgaactattattactgtacaactactttaacaatttaccctataacttaacgcccgttacggaccaacggggtaccccaagggtacggaaaacccaaggaccgtaaacgtggtacggacgttacgaccgtaaccctacgttacctgttaccc

SEQ ID NO: 279607 - DNA, 530 bp, Homo sapiens
  misc_feature: GYAE6OF02GGGLM.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaccaggacaaactcctacactcctgatctatgatgcgtccagtttagagagtggggccccagtcgaggttcagcggcagtggatcgagggacagagttcactctcaccatcagcagcctgcagcctgaagtattttgactaacttattactgtactaactactttaacaacttaccctactaacttaacgccgttacgacctaacgggacccaaggtacggaaaccaacggaccgtaacgtgtaggactcggcctaccattcctgttacc

SEQ ID NO: 279608 - DNA, 534 bp, Homo sapiens
  misc_feature: GYAE6OF02F4VNE.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagattttgctaacttattactgtacaactactttaacaacttaccctactaataacgccgttacggcccaagggaccccaagggtacgggaaacccaacggaccgaaacgttggtacggtctacggaccaccacgttcctgttaccc

SEQ ID NO: 279609 - DNA, 509 bp, Homo sapiens
  misc_feature: GYAE6OF02GB1DX.48.43.D10.1.454.CMB.1.raw
  modified_base (437)..(437): a, c, t, g, unknown or other
  misc_feature (437)..(437): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccagtcgaggttcagcggcagtggatcgagggacagagttcactctcaccatcagcagcctgcagcctgaagtatttgctaacttattactgtacaactactttaacaattaccctanataagccgttcgaccaagggacccaggtacggaaaccaagaccgaacgtgtacggctagccaccactctgtc

SEQ ID NO: 279610 - DNA, 539 bp, Homo sapiens
  misc_feature: GYAE6OF02H8NF4.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggcccatcgaggttcagcggcagtggatcgagggacagagttcactctcaccatcagcagctgcagcctagaagtattttgactaacttattactgtacaactactttaacaatttaccctactaataaacgccgtttacgaccgtaagggaccctaagggtacggaaaaccaagaccgaaactacggtaggtacctaggacctacccgaattcctagttaccg

SEQ ID NO: 279611 - DNA, 545 bp, Homo sapiens
  misc_feature: GYAE6OF02H9EQT.48.43.D10.1.454.CMB.1.raw
  modified_base (401)..(401): a, c, t, g, unknown or other
  misc_feature (401)..(401): n is a, c, g, or t
  modified_base (539)..(539): a, c, t, g, unknown or other
  misc_feature (539)..(539): n is a, c, g, or t
tcagagtatacatacacgaccggtgctcgatttagactagcagtaagggggacgaggagtcagacccactcacggaccacagcatggacatgagggtccccggctcgagctcctggggcttctgctgctctggctcccaggtgccagatgtgacgtccagttgacccagtctccatccctccctgtctgcatctggtgggagacagagtcaccctcacttgccgggcaagtcaggccatttccaattctttagcctggtatcagcagaaaccaggacaaactcctacactccctgatctatgatgcgtcctagtttagagagtggggcccatcgaggttcagcggcagtggatcgagggacagacgttcactctcaccatcagcagcctgcagctgaagtnttttgctaacttattactgtacaaactaactttaacaactttaccctactaactaacgtccgttacgaccgtaacgggacccgtaggtacggaaaccaagaccgaacgtacgtggtcgtcggacaacccgtatccgtnttaccg

SEQ ID NO: 279612 - DNA, 533 bp, Homo sapiens
  misc_feature: GYAE6OF02GFWN1.48.43.D10.1.454.CMB.1.raw
  modified_base (439)..(439): a, c, t, g, unknown or other
  misc_feature (439)..(439): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggcccatcgagttcagcggcagtggatcgagggacagagttcactctcaccatcagcagcctgcagcctgaagtattttgactaactttattactgtacaactacttttaacaactttaccctnaacttaacgccgtttacggaccaagggacccaagggtacggaaaacctaagccgaactggtacggacttcggaccacccgattacctgttaccc

SEQ ID NO: 279613 - DNA, 551 bp, Homo sapiens
  misc_feature: GYAE6OF02FJT0Z.48.43.D10.1.454.CMB.1.raw
  modified_base (213)..(213): a, c, t, g, unknown or other
  misc_feature (213)..(213): n is a, c, g, or t
tcagagtatacatacacgaccggtgctcgatttagactagcagtaagggggcaggagtcagacccactcaggacacagctatggacatgagggtccccgctcagctcctggggcttctgctgctcttggctcccaggtgtccagatgtgtacgtccagttgacccagtctccatcctccctgtctgcagtctgtgggagacagagtcaccctnacttgccggcaagtcaggccatttccaattctttagcctggtatcagcagaaaccaggacaaactcctacactacctgatctatgatgcgtccagtttagagtagtggggccccagtcgaggttcagcgcagtggatcagggacagagttcactctcaccatcagcagcctgcagcctagaagtattttgactaacttattactgtactaactactttaacaactttaccctactaattaacgtccgtttcgacctaagggacccgaagggtacggaaaaccgaacggaccgtaacgtgtacggtaccttacggaccaacctacgttcctagttaccc

SEQ ID NO: 279614 - DNA, 523 bp, Homo sapiens
  misc_feature: GYAE6OF02GT0K3.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccggcaagtcaggccatttccaattctttagcctggtatcagcagaaaccaggacaaactcctacactccctgatctatgatgcgtccagtttagagagtggggcccatcgagttcagcgcagtggatcagggacagagttcactctcaccatcagcagcctgcagcctgaagtattttgctaacttattactgtactaaactactttaaccaacttaaccctctaacttaacgaccgtttacggaccgaagggacccaaggtacggaaaccaacgacgtaactagtgactgaccacctactctgttacc

SEQ ID NO: 279615 - DNA, 546 bp, Homo sapiens
  misc_feature: GYAE6OF02FE0OT.48.43.D10.1.454.CMB.1.raw
  modified_base (195)..(195): a, c, t, g, unknown or other
  misc_feature (195)..(195): n is a, c, g, or t
tcagagtatacatacacgaccggtgctcgatttagactagcagtaagggggcaggagtcagacccactcaggacacagcatggacatgagggtccccgctcagctcctggggctttctgctgctctggctcccaggtgccagatgtgacgtccagttgacccagtctccatcctccctgtctgcatctgtggganacagagtccaccctcacttgccgggcaagtcaggccatttccaattctttagcctggtatcagcaagaaccaggacaactcctacactctgatctatgatgcgtccagtttagagtaggtcggggcccagtcgaggttcaggcggcaggtggatcgagggacagtagttccactctcaccatcagcacgcctgcagcctagtaagtattttacgacttaacttattactgtactaactactttaacaactttacccactaacgtacgtccgttaccggaccaacgggtaccaggtaacggaaaccaggaccgtaacgtggtacggtactcgaccacctacttctcgttacc

SEQ ID NO: 279616 - DNA, 543 bp, Homo sapiens
  misc_feature: GYAE6OF02F5T7E.48.43.D10.1.454.CMB.1.raw
  modified_base (371)..(371): a, c, t, g, unknown or other
  misc_feature (371)..(371): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggcccagtcgagttcagcggcagtggatcgaggacagagttcactctcaccatcancagcctgcagcctgaagtattttgctaacttattactgtacaactactttaacaatttaccctctaactaacgccgtttacgaccgtaaagggaccccaagggtacggaaacccgaacggaccggtaactcggttacggaccgttcgaccgtacccattccgtagtttaccc

SEQ ID NO: 279617 - DNA, 550 bp, Homo sapiens
  misc_feature: GYAE6OF02HTPOP.48.43.D10.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggnaagtcaggccatttccaattctttagcctggtatcagcagaaccaggacaaactcctacactcctgatctatgatcgcgtccagtttagagaggtcggggaccccatcgaggttcagcggcagtggatcgagggacaggagttcactctcacatcagcagcctgcagcctagaagttattttgacttaacttatactgtactaactactttaaacaacttaccctataactaacgtccgttacggaccaacgggacccaagggtaaccggaaaccaacggaccgtaacgtacgtacggacgttacgacctaacccgtattccgtgttaccc

SEQ ID NO: 279618 - DNA, 505 bp, Homo sapiens
  misc_feature: GYAE6OF02HJC2V.48.43.D10.1.454.CMB.1.raw
  modified_base (502)..(502): a, c, t, g, unknown or other
  misc_feature (502)..(502): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcgagggacagagttcactctcaccatcagcagctgtacgcctgagatgttagctaacttattactagtactaaagtatactacttcgtccctactcctaccttcgaccaacggacacgacgtggagtaataacgaaaacgtgtacggctgcactactntcg

SEQ ID NO: 279619 - DNA, 547 bp, Homo sapiens
  misc_feature: GYAE6OF02HDZK5.48.43.D10.1.454.CMB.1.raw
  modified_base (208)..(208): a, c, t, g, unknown or other
  misc_feature (208)..(208): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctnacttgccgggcaagtcaggccatttccaattctttagcctggtatcagcagaaccaggacaaactcctacactcctgatctatgatgcgtccagtttagagagtcggggcccatcgaggttcagcggcagtggatcgagggacaggagttcactctacaccatcagcagcctgtacncctgaagtntttgactaacttattactgtacaactactttaaacaatttaccctataacttaacgtccgttacgaccgtaacgggaccctagggtacggaaaccaaggaccgtaacgttggtacggccgtcggaccacctaagttccttagttccttacccg

SEQ ID NO: 279620 - DNA, 596 bp, Homo sapiens
  misc_feature: GYAE6OF02I8JE2.48.43.D10.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
tcagagtatacatacacgaccggtgctcgatttagactagcagtaaggggacgaggagtcagacccactcacggaccacagcatggacatgagggtccccgctcgagctcctgggcttctgctgctctggctcccaggtgccagatgtgacgtccagttgacccagtctccatcctccctgtctgcatctgtggganacagagtcaccctnacttgccgggcaagtcaggccatttccaattctttagcctggtatcagcaagaaaccaggacaaactcctacactcctgatctatgatgcgtccagtttagagagtgggccccatcgaggttcagcgcagtgatcagggacaggagttcactctcaccatcagcagcctgcagcctgaagtattttgctaaactttattactgtactaaactaccttttaaacaaacttttaaccctactaacgttaaacgtcccggtttaccggaccgtaaacggggtaccccaagggttaaccgggaaaaacccgtaaacggaccggtaaaaccgttacggttacgggtaccgttacggtaccgtaaccccgaagtttcccgtaggtttaccc

SEQ ID NO: 279621 - DNA, 570 bp, Homo sapiens
  misc_feature: GYAE6OF02F4UL4.48.43.D10.1.454.CMB.1.raw
  modified_base (396)..(396): a, c, t, g, unknown or other
  misc_feature (396)..(396): n is a, c, g, or t
tcagagtatacatacacgaccggtgctcgatttagactagcagtaagggggcaggagtcagacccactcaggacacagcatggacatgagggtccccgctcagctcctgggcttctgctgctctggctcccaggtgccagatgtgacgtccagttgacccagtctccatcctccctgtctgcatctgtgggagacagagtccaccctcacttgccgggcaagtcaggcctatttccaattctttagcctggtatcagcagaaccaggacaaactcctacactcctgatctatgatgcgtccagtttagagagtcggggcccagtcgaggttcagcggcagtggatcgagggacagtagttcactctcaccatcagcagcctgcagcctagaagttntttgactaacttattactagtactaactactttaacaacttacccttacaacttaacgccgtttaccggacccgtaacgggaccctaagggtaaccggaaaacccgtaacggtaccggtaaaccgttggtacggtccgtacggaccctaccgtaacgttccgttacggttaccc

SEQ ID NO: 279622 - DNA, 544 bp, Homo sapiens
  misc_feature: GYAE6OF02ISD0Z.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcacccctcacttgccgggcaagtcaggccattccaattctttagcctggtatcagcagaaaccaggacaaactcctacactcctgatctatgatgcgtccagtttagagaggtggggccccagtcgaggttcagcggcagtggatcgagggacagagttcactctcaccatcagcagcctgcacgcctagaagtattttgactaactttattactgtacaaactaactttaaacaatttaccctataacttaacgtcccgttacggacccgaaggggaccccaagggttacggaaaaccaaggaccgaactggtaggctaggccaacctactccgtcgttacc

SEQ ID NO: 279623 - DNA, 548 bp, Homo sapiens
  misc_feature: GYAE6OF02G0CRK.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggcaagtcaggccatttccaatttcttagcctggtatcagcagaaaccaggacaaactcctaacactcctgatctatgatgcgtcctagtttagagaggtcggggccccagtcgaggttcaggcggcaggtggatcgagggacagagttcactctcaccatcagcagcctgcacgcctagaagttattttcgacttaactttattactagtactaacttaactttaactaacttacccttataacttaacgtccgttacggaccgaacgggaccctagggtaacggaaaccgaagacgaacgtaggtcgactacgaccacctagtctgttcc

SEQ ID NO: 279624 - DNA, 520 bp, Homo sapiens
  misc_feature: GYAE6OF02FLYCU.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccagtcgaggttcagcggcagtgatcagggacagagttcactctcaccatcagcagcctgcagccctgaagtattttgctaacttattactgtactaactactttaacaacttaccctctaataacgtccgttacggacctaacgggacccaggtacggaaaaccacggacgaactgtaggctgaccaccattcgtgttcc

SEQ ID NO: 279625 - DNA, 537 bp, Homo sapiens
  misc_feature: GYAE6OF02FQLS7.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggcccatcgaggttcagcggcagtgatcgagggacagagttcactctcaccatcagcagcctgcagcctgaagatgttgacaactttattacttgtaactaaaagtactactaactttcgaccccctaatccctaaccgttccggaccgtaagggacctaacgtacgtacggacgtaacttaaaccgaacgtagtcggtacctaggacctaccgtattaccg

SEQ ID NO: 279626 - DNA, 530 bp, Homo sapiens
  misc_feature: GYAE6OF02I22IE.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctggtatcagcagaaaccaggacaaactcctacactcctgatctatgatgcgtccagtttagagagtcggggccccagtcgaggttcaggcggcaggtggatcgagggacagagttcactctacaccatcagcagcctgcacgcctagaatgttttcgactaacttattactgtactaactactttaacaacttaccctataactaacgccgttaccggaccaacgggacccagggtacgaaaccaaggacgtaacgtgtggactcgacctacacttctgttacc

SEQ ID NO: 279627 - DNA, 611 bp, Homo sapiens
  misc_feature: GYAE6OF02JC211.48.43.D10.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctnacttgccgggcaagtcaggccattccaattcttagcctggtatcagcagaaccaggacaaactcctacactcctgatctatgatgcgtccagtttagagagtggggccctagtcgaggttcagcggcagtggactcgagggacagtagttcacgtctacaccatcgagcagcctgcagccctagtaacgttattttacgacgtaaactttacttacttacgttacctaaaccttaacctttaaacctaactttaaccccttactaaacgtttaacgtcccgtttaccgggaccctaaaccggggacccctaggggttaaccggaaaacccgaacggtaccggtaaaccgttgggtacgggtaccttacggtacccgaaccctacgtaccgttacgtttacccg

SEQ ID NO: 279628 - DNA, 552 bp, Homo sapiens
  misc_feature: GYAE6OF02FVSOB.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggcaagtcaggccatttccaattctttagcctggtatcagcagaaaccaggacaaactcctacactcctgatctatgatgcgtccagtttagagagtggggcccagtcgaggttcagcggcagtggatcgagggacagagttcactctcaccatcagcagcctgcagcctgaagtatttgactaacttattactgtactaactactttaacaactttaccctactaacttaacgtcccgtttacggaccctaacggggaccctaagggtacggaaaaccaacggaccggtaaacgttcggtaggacctcggacctaccctacgttacctgttaccc

SEQ ID NO: 279629 - DNA, 522 bp, Homo sapiens
  misc_feature: GYAE6OF02GK6YT.48.43.D10.1.454.CMB.1.raw
  modified_base (194)..(194): a, c, t, g, unknown or other
  misc_feature (194)..(194): n is a, c, g, or t
  modified_base (411)..(411): a, c, t, g, unknown or other
  misc_feature (411)..(411): n is a, c, g, or t
  modified_base (441)..(441): a, c, t, g, unknown or other
  misc_feature (441)..(441): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccggcaagtcaggccattccaattctttagcctggtatcagcagaaccaggacaaactcctacactcctgatctatgatgcgtcctagtttagagagtcggggaccccagtcgaggttcagcggcaggtggatcgagggacaggagttcactctacacatcagcagcctgcagcctagaagtacttttagactaattnttactagtcaactactttaacaattacccntaactaacgcgttacgaccgaacggacctaggtacgaaaccgaagacgaactgtacggactggaccacctatcgtgttacc

SEQ ID NO: 279630 - DNA, 585 bp, Homo sapiens
  misc_feature: GYAE6OF02IJCN8.48.43.D10.1.454.CMB.1.raw
  modified_base (267)..(267): a, c, t, g, unknown or other
  misc_feature (267)..(267): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagagtcaccctcacttgccgggcaagtcaggcctatttccaattctttagcctggtatcagcagaaaccnggacaaactcctacactcctgatctatgatgcgtccagtttagagagtcggggcccagtcgagttcagcggcagtgancgaggacagngttcactctcacatcagcagctgcagcctagaagttattttgactaacttattacagttacaaacttaacctttaactaacttaccctataacgttaacgtccggtttaccggaccctaaacggggaccccgtaagggtaaccggaaaacccgtaaacggtaccggtaaaccgttcgggttacggtaccgtaccggtaccgaaccccgtagtttcccgtaggtttacccc

SEQ ID NO: 279631 - DNA, 564 bp, Homo sapiens
  misc_feature: GYAE6OF02I1B6D.48.43.D10.1.454.CMB.1.raw
  modified_base (219)..(219): a, c, t, g, unknown or other
  misc_feature (219)..(219): n is a, c, g, or t
  modified_base (375)..(375): a, c, t, g, unknown or other
  misc_feature (375)..(375): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcacctcacttgcccgggnaagtcaggccagttccaattcttagcctggtatcagcagaaccaggacaaactcctacactcctgatctatgatcgcgtcagtttagagtacgtcggggcccagtccggaggttcgaggtcggcgaggtggatcgagggacaggtagttacactcncaccatcagcagcctgcagcctgtaacgttatttacgactaacttattactacgtacaacttaactttaactaacttacctactaacgttaacgtccgttacggaccgtaacgggaccctaggtaaccggaaaccgacgtaccggaacgttggtacggtacgtcgaccaccgtacttccgttagttacc

SEQ ID NO: 279632 - DNA, 579 bp, Homo sapiens
  misc_feature: GYAE6OF02HJ4YV.48.43.D10.1.454.CMB.1.raw
  modified_base (463)..(463): a, c, t, g, unknown or other
  misc_feature (463)..(463): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggagcccatgctgcaagtcgggccagaggtgccctgaacctgaaggccaatgagaccaagacagccaagtgggtgtgagacccctggaggagcgtgggcctggtcccaggcagcgctcggcccctgctgctgcgtgggtctggccagtcggtcgcccgatcgggcctgctcgccgcccgtaagtcggttcgctaaccgcgaaacggccgggaacccacgacccgtcggacgcctacgngttacggaacgcgagccgatccgacgccgtcgcggacgcgtggtcgggcgcggtccgacggacccgaacggcccgtacggccccgtccggtcctaccgttccgttccgttcccccg

SEQ ID NO: 279633 - DNA, 749 bp, Homo sapiens
  misc_feature: GYAE6OF02FP1GJ.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagtatgtgaccgtcctagttcgacccagtcctccatccctccctgtctgctatctggtgggacgacagtacgtcccaccctctacgttcggcccgggacaagtcgacggcctactttacctaatttctttacgccgttggtatcagacaacgaaaccgagaactaaacctcctactacctctagtactactagtagtatcgtccgtaccgtagtttaggaggtacgggtcccggggaccctagtaccggttacggttacgacgggcggacgtagggtaggacgtacggaagggaacgtaaggttacgttaccaccgttcctaccgaaccctactaccgacgaccaccgtccgtacgaccaccggtcctaaggtaaacgtttacgttttacgtaaccttaaacgttttacttaccgttacgtaacctaaaacctttaacctttaaacctaaacctttaccctaacttaaacgttaaccggtcccggttaaccggaacccggtaaccgggacccgtaagggtaaaccggaaaacccgaacggtaacccggtaaacgttcggtaccggtacgtaccggacccctaaccgtacgtttacccgttaggttacccc

SEQ ID NO: 279634 - DNA, 561 bp, Homo sapiens
  misc_feature: GYAE6OF02F4EFE.48.43.D10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
  modified_base (448)..(448): a, c, t, g, unknown or other
  misc_feature (448)..(448): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctggtggganacagagtccaccctcacttgccgggcaagtcaggcctatttccaattctttagcctggtatcagcaagaaccaggacaaactcctacactcctagatctatgatgcgtccagtttagagngtcggggccctagtcgaggttcagcggcagtgatcgagggacagtagtcactctcaccatcagcacgcctgcgagcctagaagttatttgacttaacttatactgtactaactaactttaacaacttacctnaacttaacgtccgttacgaccgtaacgggacctaagggtaaccgaaaccgtaacggaccggtaaacgttcgggtacgtccgtacgacccgtaaccgtacttcgtctttacccg

SEQ ID NO: 279635 - DNA, 558 bp, Homo sapiens
  misc_feature: GYAE6OF02GRFZ0.48.43.D10.1.454.CMB.1.raw
  modified_base (195)..(195): a, c, t, g, unknown or other
  misc_feature (195)..(195): n is a, c, g, or t
  modified_base (403)..(403): a, c, t, g, unknown or other
  misc_feature (403)..(403): n is a, c, g, or t
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagacgtcaccctcacttgccgggcaagtcaggccatttccaattctttagcctggtatcagcagaaaccaggacaaactcctacactcctgatctatgatgcgtccagtttagagtaggtcggggcccagtcgaggttcagcggcagtggatcgagggacaggacgttcacctctccacactcagcagcctgcacgcctagaagtnttttcgacttaacttattactgtactaaactaactttaacaaacttacccttacaacgttaacgtcccgttacggacccgtaagggacccaagggtaccggaaaaccgaacgaccgtaacgtacgtcggtctacggaccacctatccgtgttacc

SEQ ID NO: 279636 - DNA, 528 bp, Homo sapiens
  misc_feature: GYAE6OF02F9YUC.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagaggtcggggccccatcgaggttcaggcggcagtggatcgagggacagagttcactctcaccatcagcagcctgccagccctagaagtattttgactaacttattactgtacaactactttaacaactttaccctataataacgccgtttacgacctaacgggacccagggtacggaaaccgaagacgtaactgtcggactcgaccacattctgttacc

SEQ ID NO: 279637 - DNA, 519 bp, Homo sapiens
  misc_feature: GYAE6OF02F140S.48.43.D10.1.454.CMB.1.raw
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacgagagtcaccctcacttgccgggcaagtcaggccatttccaattctttagcctggtatcagcagaaccaggacaaactcctacacctcctgatctatgatgcgtcctagtttagagagtcggggcccagtcgaggttcagcggcagtgatcgaggacagagttcactcncacatcagcagcctgacagcctagaagttnttttagactaacttagtactgtacaactacttaaacactttacccntaataacnccgttacgaccgaacggaccaggtaacgaaccaagacgtaacgtgtcgactgacctacgactctgttacc

SEQ ID NO: 279638 - DNA, 513 bp, Homo sapiens
  misc_feature: GYAE6OF02HBJSW.48.43.D10.1.454.CMB.1.raw
  modified_base (363)..(363): a, c, t, g, unknown or other
  misc_feature (363)..(363): n is a, c, g, or t
  modified_base (402)..(402): a, c, t, g, unknown or other
  misc_feature (402)..(402): n is a, c, g, or t
  modified_base (505)..(505): a, c, t, g, unknown or other
  misc_feature (505)..(505): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccagacaaactcacactctgatctatgatgctccagtttagagagtcggggcccagtcgagttcagcggcagtgatcgagggacagagttcactctcaccntcagcacgctgcagcctagaagttatttagactaacttnttaactgtactaactactttaaacaacttaccctatacttaacgtccgttacgaccgaacggaccaggtaacgaacgagacgaacgtcgtgtctcgcaccgtnttctgttc

SEQ ID NO: 279639 - DNA, 547 bp, Homo sapiens
  misc_feature: GYAE6OF02JGPKW.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggcctatttccaattcttagcctggtatcagcagaaaccaggacaaactcctaacactcctgatctatgatgcgtcctagtttagagaggtcggggcccagtccggaggttcagcggcaggtggagtcgagggacagtacgttcacgtctcaccatcagcacgcctgcacgcctagaacgtattttgacttaacttattactagttaacaaagttacttactactttcgacccctatcctaccgttcggaccgtaacggacaccggatacggaagtaacgttaaacgacgttgtacggtacctcgacctaaccagtcttacg

SEQ ID NO: 279640 - DNA, 563 bp, Homo sapiens
  misc_feature: GYAE6OF02F8TU0.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtccaccctcacttgccgggcaagtcaggcctatttccaattctttagcctggtatcagcagaaaccaggacaaactcctacactcctgatctatgatgcgtccagtttagagtaggtcggggcccagtcggaggttcaggcggcaggtgatcgagggacaggatcactctacaccatcagcagcctgcacgcctagtaagttattttgacttaactttacttactacgttaactaacttaacctttaaactaaccttaccctataacgtaacgtccgttacggaccgtaacgggtaccaagggtaaccgaaaccgaagtaccgtaacgttgtacggtctacgaccactacttcgtcgttaccc

SEQ ID NO: 279641 - DNA, 621 bp, Homo sapiens
  misc_feature: GYAE6OF02IARRA.48.43.D10.1.454.CMB.1.raw
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagagtatacatacacgaccggtgctcgatttagactagcagtaagggggcgaggagtcagacccactcaggacacagcatggacatgagggtccccgctcagctcctggggcttctgctgctctggctcccaggtgccagatgtgacgtccagttcgacccagtcctccatccctccctgtctgcatcgtgtagggagacaggatccacctcgacttcggccgggacaaagtcacggcctaattttcccaatttctttaagccttaggtactcaaggcaaggaaaaccaggaactaaacctcctaacaacctccttagaacttctagtgatcgcgtcctagtttagagagtcgggcccatgacgtnagcgnagtgatcgagganagngttcactctcgaccatcagcacncctgcacgcctagacgttatttcgacttaacttatactagtactaaacctaatttaaacctaactttaccctactaagttaaccgtccgtacccggtaccgtaaacgggaccccgtaagggtaaccgaaaacccgaaacggtccggtaaaaccgtggttaccggacgttaccggaaccctaaccggtaacttcctaacggttttacccg

SEQ ID NO: 279642 - DNA, 550 bp, Homo sapiens
  misc_feature: GYAE6OF02GX2R7.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagagtcaccctcacttgccgggcaagtcaggccatttccaattctttagcctggtatcagcagaaaccaggaccaaactcctaacactcctgatctatgatgcgtcctagtttagagaggtcggggcccctagtcggaggttcagcggcaggtggatcgagggacagtacgttcactctcaccatcagcacgtccctgaccacgtcctagtaagttattttacggacttaactttattactagtacctaaactaactttaaactacttacctataactacgtccgttacgacgaacggtaccgaggtacgaaaccaaggaccgaagtcgtaggctagaccactctctgttacc

SEQ ID NO: 279643 - DNA, 600 bp, Homo sapiens
  misc_feature: GYAE6OF02IDSGH.48.43.D10.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatcctccctgtctgcatctgtggganacagagtcaccctcacttgccgggcaagtcaggcctatttccaatttctttagccttggtatcagcagaaaccaggacaactcctacactcctagatctangatcgtcgtctagttagagtaggtcgggcccatcgagttcagcgagagtggatacgagggacaggtacgttcgacttcacaccatcagcacgactcgacacgtcctagaagttatttcgacttaactttattactacgtactaaaccttaactttaaccaaactttaccctactaattaaccggtccgttacggaaccgtaacgggacccgtaagggtaaccggaaaacccgtaacggaccggtaacgttacggtacggtaccctacggtaccctaaaccgtacttaccgttacggtttaaccc

SEQ ID NO: 279644 - DNA, 714 bp, Homo sapiens
  misc_feature: GYAE6OF02JNLJ9.48.43.D10.1.454.CMB.1.raw
  modified_base (195)..(195): a, c, t, g, unknown or other
  misc_feature (195)..(195): n is a, c, g, or t
tcagagtatacatacacgaccggtgctcgatttagactagcagtaagggggcgaggagtcagacccactcaggacacagcatggacatgagggtccccgctcagctcctgggcttctgctgctctggctcccaggtgccagatgtgacgtccagttgacccagtcctccatcctccctgtctgcatcgtgtgganacagacgtcaccctctacgttcgccgggactaacgtcacggcccttagtttacccaattttcctttagtcccgttaggtacttacgacggaccaacggaaaaccgaggtaaacctaaaccgttccctaacctaaccctcctacgtacttactaactcgacgttcgtcgtacccttaaggttacgtagtacggttccggggaccctacgttcggacgttacgacggaccggtcgaacggtgacgtacgaggaacgcgtacgttcacgtctaccgacacgtcgacgccacgacctcgactacgtacgtacgtaacgttacttttacgaaccgttaactttaacttaccgttacgtaacttaaaccgttaaccttttaaaccgtaacctttaacccttataaaccgttacggtaaccgtttcccggaaccgtaacccgggtacccgtaacggtaaccggtaaaccgaacgaccgtaaacggtcggtacgtacgtaccgaccgtacctacgtacctcgttacc

SEQ ID NO: 279645 - DNA, 623 bp, Homo sapiens
  misc_feature: GYAE6OF02GCEPN.48.43.D10.1.454.CMB.1.raw
  modified_base (195)..(195): a, c, t, g, unknown or other
  misc_feature (195)..(195): n is a, c, g, or t
  modified_base (331)..(331): a, c, t, g, unknown or other
  misc_feature (331)..(331): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtggganacagagtccaccctcacttgccgggacaagtcaggccatttccaattcttagcctggtatcagcagaaaccaggacaaactcctaacactcctgatctatgatgcgtccagtttagagtagtcggggcccagtcgnggttacaggcggcaggtggactcgagggacaggtacgttcactctcaccatccagtcacgtcccgtgccacggtcctagaagttactttagacttaaacgttattacctagttacctaaaccgtaactttaaaccgtaacctttaaccctaccgtaattaaccggtcccggttacggaacccgaacgggtaccccgtaagggtaccggaaaacccgtaacggtacggaaaccgtttacgggtcgggtaccgttacggacccgttaaccgaacgtttcccgtacggtttaccc

SEQ ID NO: 279646 - DNA, 604 bp, Homo sapiens
  misc_feature: GYAE6OF02IHKZ2.48.43.D10.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggnaagtcaggcctatttccaattctttagcctggtatcagcaagaaaccgaggaccaaactcctaactactcctgactctatgatgcgtacctagtttacgagtacggtcggggccctagtcggaggttcaggtcggacaggtggtactacgagggacaggtacgttcactcgtacacctatcacgcacgccgtgacgtacgtcctagtaacgttacttttacgacttaactttactacgtagtacctaacttaactttaacctaacgttacctacgtacgtaacgtccgttacgaccgtaacggaccgtacgggtaacgaaaccgtaagtaccgtaaccgttcggtacgtacgtacgtaccgaacccgtacttccgttagttaccc

SEQ ID NO: 279647 - DNA, 565 bp, Homo sapiens
  misc_feature: GYAE6OF02FGSC4.48.43.D10.1.454.CMB.1.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtcagtttagagagtggggcccatcgaggttcagcggcagtggatcgagggacagagttcactcncacancagcagcctgccagcctagaacgtattttgacctaactttacttactcgtactaaacctaacttttaaacaactttaaccctctaaactaacgtcccgtttacggacccgtaacggggaccctaacgggtacggtaaaacccaaggaccggtaaacttcggtaggtaccttcggacctacctaacgttccttagttcc

SEQ ID NO: 279648 - DNA, 591 bp, Homo sapiens
  misc_feature: GYAE6OF02HET8E.48.43.D10.1.454.CMB.1.raw
  modified_base (229)..(229): a, c, t, g, unknown or other
  misc_feature (229)..(229): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggancccatgctgcaagtcgggccagaggtcgccctgaacctgaaggccaatgagacccaagacaggccaagtgggttgtgacgaccccgtgaggagcgtcgggccctggtcccaggcagcgctcggccctgctgctgcgtgggtctggcctagtcgtcgccagtcggcctgctcgcgcctaagtcgtgcgaccgcgaacggccgggaaccctacggacccgtacggacgcccgtcgagttacggacgcgaggcccgactccgacgccgtgaccggacgccgtgggcggggcgtagggtccgacggaccccgaggcccgtccggacccccgttcggtaccctaccgttccgtacccgttcccccgg

SEQ ID NO: 279649 - DNA, 605 bp, Homo sapiens
  misc_feature: GYAE6OF02G00U9.48.43.D10.1.454.CMB.1.raw
  modified_base (196)..(196): a, c, t, g, unknown or other
  misc_feature (196)..(196): n is a, c, g, or t
  modified_base (413)..(413): a, c, t, g, unknown or other
  misc_feature (413)..(413): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctggtggganacagagtccaccctcacttgccgggcaagtcaggcctatttccaattctttagcctggtatcagcagaaaccaggacaaactcctacactcctgatctatgatgcgtcctagtttagagtacggtcggggaccccagtcggaggttcaggcggcaggtggatcgaagggacaggattcacctcacaccatcagcacgcctgcacgcctagtaagttntttcgactaactttacttacttacgtactaaaccgtaaccttttaaacctaacttaacccttactaacttaacggtcccggtttaccggaccgtaaccgggtacccgaagggttaaccggaaaacccgaaggtaccggaaaccgttaggtcggtaccgtacggacctacccggttacttccgtgttaccccg

SEQ ID NO: 279650 - DNA, 567 bp, Homo sapiens
  misc_feature: GYAE6OF02FSI74.48.43.D10.1.454.CMB.1.raw
  modified_base (375)..(375): a, c, t, g, unknown or other
  misc_feature (375)..(375): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtccacctcacttgccgggcaagtcaggccatttccaattctttagcctggtatcagcagaaaccaggacaaactcctacactcctgatctatgatgctcctagtttagagaggtcggggcccagtcgaggttcagcggcagtggatcgagggacaggtagttcactctcacctancagcacgcctgcagcctgaacgttatttcgactaactttacttacttagtacctaacttaacttttaaccgaactttaccctactaacgtaacgtccgttacgaccgtaacgggtacccaagggtaccgaaaccgaaggtaccgaaacgttggtacggtactcggacctaacctcgttaccgtagttacccg

SEQ ID NO: 279651 - DNA, 547 bp, Homo sapiens
  misc_feature: GYAE6OF02FQZLN.48.43.D10.1.454.CMB.1.raw
  modified_base (194)..(194): a, c, t, g, unknown or other
  misc_feature (194)..(194): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtccaccctcacttgccgggcaagtcaggccatttccaattctttagcctggtatcagcagaaaccaggacaaactcctacacctcctgatctatgatgctccagtttagagagtcgggacccagtcgaggttcagcggcaggtgatcgagggacagacgttcactcnccacatcagcacgcctgcacgctagaagttatttgacttacttactactntactaactactttaaacctattaaccctacaacgttaccgtccggttacgacccgaaccgggacccgtacggtacgaaacccgacggtaccgaacttcggtagaccgtgaccgtaccattcctgttaccc

SEQ ID NO: 279652 - DNA, 665 bp, Homo sapiens
  misc_feature: GYAE6OF02H37ET.48.43.D10.1.454.CMB.1.raw
  modified_base (395)..(395): a, c, t, g, unknown or other
  misc_feature (395)..(395): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtcctgcatctggtggagacagagtcaccgtcacttgccggcaagtcaggccatttccaattctttagcctggtactcagcagaaccaggaaaactctacactctgatctagtgatgacgtccagtttagagacgtcgggaccccagtccgaggttcgacgtcgcgagtcggagtcgaagggacagtacggtccacgtcgtccgacctatcgacgacncgccctgacctacggcctaggtaaacgtacgttttcgaaccgttaaactttaacctttacgtacggtaaccctaaacgtaacccgttttaaaactaaccgttttaaacccctcgttaaacgttaaccggttacccgttacggaaccccgtaaacgggggtaacccctaagggtaaccggtaaaacccgaacggtaacccgtaaacggtacggttaccggaccgttcggaacctaaccccgtacgtttaccgtccggttacctttaaccgg

SEQ ID NO: 279653 - DNA, 607 bp, Homo sapiens
  misc_feature: GYAE6OF02H7JWI.48.43.D10.1.454.CMB.1.raw
  modified_base (198)..(198): a, c, t, g, unknown or other
  misc_feature (198)..(198): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtcctccatccctccctgtctgcatcgtggtggganacagacgtccaccctcacgttcgccgggacaagtcaggtcctatttaccaatttcttttagccttggtactcagacaagaaaccaggaaccaaactcctaacacctccctagactactatgtatcgccgtacctagtttagaggtacggtcgggcccagtcgtaggtcaggcgnaggtgatcgagggacagtacgtcactcnccacatcgacgcacgcctgaccacgcgtagtaacgttcttttacgacttaacttattacgtacgtactaaaccttaactttaactaaccttacctaactaacgttaaccgtcgtaccgaaccgacggtaccgtaacggtaacggaaccaacgtaccgtaacgttcggtacggtctacggacctaacctgttacccgttgttaacccc

SEQ ID NO: 279654 - DNA, 732 bp, Homo sapiens
  misc_feature: GYAE6OF02IGA9T.48.43.D10.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
tcagagtatacatacacgaccggtgctcgatttagactagcagtaagggggcgaggagtcagacccactcaggacacagcatggacatgagggtccccgctcagctcctgggcttctgctgctctggctcccaggtgccagatgtgacgtccagttgacccagtctccatcctccctgtctgcactctggtggagactagacgtcaccctnacgttgccgganaagtcaggccctattccaatttctttacgccttaggtactcagctacgaaacgagaaccaaactcctacactcctagactctatcgtaatcgtccgtaccgtagttttaggaacgtcggttaccggggacccctaagttcggtaacggtttccaacggtccgggtaaccgtaggtttacgggagttaccggaacggggtaactacgggtaacttacccgtacgtttcccgtacctaaaccgtacgttacgaccgtacgaccgttccgtacgactaccggtaccttagtaaccggtttagtttacctaccgttaaaccttttagttaccgtaacggtttaaccctaaaccgttaaccttttaaacaaccccttttaaccgtaaccagttaaacccggttccgttaacccggaacgtaacccgggtaaccgaggttaacccgggaaaaaccgtacgtaaccggtacgttacgtggtaaccgacgtaccaccgtaacggttctacgttaccg

SEQ ID NO: 279655 - DNA, 690 bp, Homo sapiens
  misc_feature: GYAE6OF02HWKKW.48.43.D10.1.454.CMB.1.raw
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttgacccagtctccatcctccctgtctgcatctgtggagacagagtcaccctcacttgccgggcaagtcaggcctatttccaattctttagccttggtatcagcagaaaccaggaacaactcctacactcctgatctatgatcgcgtccagtttagagtaggtcggggcccctagtcggtacggtcgacgggcggacgtaggtaggtacgtacggaacgggaacgtaacggttaccgttaccgtacgttcctacccaaccgtactacgacgacgacgtaccgtcgaccgtaccgtaccgtaagtaacgtttacgtttaccgtaactttaacgtttacttacgtacgttaactaaaccgtttaaacttaaaccgtaacctttaacccgtactaaacgttaccggttaccgttaccggtaaccggtaaccggtaccggtaacgggtaaccggtaaaaccggtacggaaaccggtaaccggttacggtaccggtacgtaccggtaaccctaaccgtacgtttcgtacgtttaaccccg

SEQ ID NO: 279656 - DNA, 652 bp, Homo sapiens
  misc_feature: GYAE6OF02HZGWG.48.43.D10.1.454.CMB.1.raw
  modified_base (289)..(289): a, c, t, g, unknown or other
  misc_feature (289)..(289): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtcctccatcctccctgtctgcatctggtgggagacagacgtccacccttcacgttggccgggacaagtcaggccctatttccaattctttacgcctggtatcagcagaaccaggacaactcctacnctctgatctatgatcgcgtcctagtttagagtaggtcgggacccagtcgacgttcgacggcggacgtaggtaggacgtcgagggacaggtacgttaccgactccgtaccaacactacacgacacgtccgtacgtacgtcgtaggtaagttactttacggaacttaaacgtttactttactaacgtacctaaacgttaaccttttaaacaaccttttaaccccgtactaacgttaacggtcccggttacggaacccgtaaccgggtacccgtaaggggttaaccgaaaccggaacggtaacccggtaacgtcggttacggacccttggaccctaaccttacgttaccgttcgttacccttaccg

SEQ ID NO: 279657 - DNA, 613 bp, Homo sapiens
  misc_feature: GYAE6OF02F45PJ.48.43.D10.1.454.CMB.1.raw
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
tcagagtatacatacacgaccggtgctcgatttagactagcagtaagggggcaggagtcagacccactcaggacacagcatggacatgagggtccccgctcagctcctgggcttctgctgctctggctcccaggtgccagatgtgacgtccagttgacccagtctccatcctccctgtctgcatctgtgggagaccagactccaccctcacttcgccgggcagtcaggcccatttccaattctttagcctggtactcagcagaaccnggacaaccncctacactcctgatctatgatgcgtccagtttagacgtacgtcggggtccccagtccggaggttcacgcggcagtggaactcgagggacaggtacgttacactctcaaccatcacgcacgtccgtgccacgcctagaacgtacttttcgacctaacttacttacctcgtaactaaacctaacctttaaacctaaccttaaccctacgtaacttaaaccggtcccggttacgggacccgaaaccggggtacccaagggtaaccggaaaacccgaacggtaccgtaaaccgttcggtaacggtccgtacggaccctaaccgtatccgttacggttaccc

SEQ ID NO: 279658 - DNA, 632 bp, Homo sapiens
  misc_feature: GYAE6OF02IO693.48.43.D10.1.454.CMB.1.raw
  modified_base (210)..(210): a, c, t, g, unknown or other
  misc_feature (210)..(210): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtggagacagacgtccaccctnacttggccgggacaagtcaggcctattccaattcttagcctggtatcagacaagaaaccaggaacaaactcctacactcctagatctatgatcgcgtactagtttagaggtaggtccggggaccctagtcggtaggttacaacggtcggactaggtcggaatacggaagggaactaaggtacggttaccaacttctacaacctatacagcagccgtagactacgtcctaggtaaacgttattttacgacttaacgttaattactacgtaactaaaccgttaactttaaactactttaaccctactaacgttaacggtacccggttacgaaccgtaaccgggaccctaagggtaaccggaaaccaacggtacggtaacgttggtacgacctagacccgtaacctacgttaccgtacgttaccg

SEQ ID NO: 279659 - DNA, 863 bp, Homo sapiens
  misc_feature: GYAE6OF02J1GST.48.43.D10.1.454.CMB.1.raw
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaagtggacgtggggtgtactgtaacagccctgcgtggcgagagggaccagggcaccgtcctccgagggacgccatgcctgccaaggtccgggaccaggaggtcgcccctagaaccgtgaaggccaagtcgaacgaaccccgaagaccgacgggacctaaagggtggggtttacgtcggaacggtacccccgttaggaacgggaacggccgtacggggtcccccgttacgggtaccccgacgggccgaacggtccgtccgtccgggcccccgttggcccgttcggccgttcgggccgttcgggggttcccgtcgggtaacccgtggttccgggttcccgccccggtaaggtcccgggttccgttcggcgtccgacccggtccgtaacgtcgggtttaccgcccgtaacccgggaaccgtaaaccggggaccccgggggaacccgtaaccggtacccccggtgggtaaccccggtaccgtacccggtaagggtttaacccgggaaccgtacgggtaaccgtacccgggttaccgtacccgaaacggtacccggtcgggtaaccggtaccgggtccgtacggggtacgggtaccggtaccggggttaccgaaccggtacccccgggtaacgcccgggttaccccggtacccccgggttccggtacccggttaaccgtttccccggcccggttttaccccccggg

SEQ ID NO: 279660 - DNA, 654 bp, Homo sapiens
  misc_feature: GYAE6OF02I3A0Q.48.43.D10.1.454.CMB.1.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (518)..(518): a, c, t, g, unknown or other
  misc_feature (518)..(518): n is a, c, g, or t
  modified_base (551)..(551): a, c, t, g, unknown or other
  misc_feature (551)..(551): n is a, c, g, or t
tcagagtatacatacacgaccggtgctcgatttagactagcagtaagggggcagggagtcagacccactcaggacacagcatggacatgaggtcccgctcagctcctgggcttctgctgctctggctcccaggtgccaggactgtcgacgtccagttcgacccagtcctcactcctccctgtctgacntctgtaggagacagacgtcaccctntacgttcgccggacaagtcacggcctatttccgtaattcttagccttaggtactcgaacgacaacgaaacccgaaggaaccaaacctccttaaaccaccttaccgtacgaattcctaagtgaacttcgtcgttacttaaggttacgacggtacggttccgggaccctaaggtcgtaaggttcagggtcgcgtaaggtcgaactcggaacggactaagtcgtaccgtaacgtcctaccgaacctacgtacgacgtacgacgtcctggacacgccgtagtaattcgtttagcctaaatttataccgngtactaaacgttactttaaacgtacttaaccgnttaacgtaacgggcccgttaaccggacgtaaccggcttaacgggtaacgaaaccggaagtacgtacgtacggtcaccgtacaccaccgttactcgtcgttacc

SEQ ID NO: 279661 - DNA, 873 bp, Homo sapiens
  misc_feature: GYAE6OF02HXSRE.48.43.D10.1.454.CMB.1.raw
  modified_base (226)..(226): a, c, t, g, unknown or other
  misc_feature (226)..(226): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacaggacgtcaccctctacgttggcccggganaaacgtcgacggtcctatttccaaatttcttttagcccgttaggtactcacggtacaacggaaaaccaacggaaacctaaaaccgttaccccttaacctaacccgttacccctaggtaacttaccttaacgtacggtaattcggtaccgttacccgttaaggttttaacggaaggtacgggttaccgggggtaccccctaaggttccgggtaaggtttaccgacgggccgggtacgtacgggtttacgggaacgtaccgggaaacgggggtaacgtaaggtaacggtttacccgacgtttaccgtaaccgtaacccctagtacccgacgggtaacccgtaacggtcccttacggaaccgtaacggtacccgttagggtaaacgtttaacggttttacgtaacctttaaacgtttaacttaaccgttaccggttaaacctaaaaccctttaaaccttttaaaccgttaaaccctttaacccgtaacctttaaacgtaaaccggttacccgggttaacccgggtaacccggtaaccgggtaacccgtaacgggttaacccggtaaaaacccgtaccgggaaccgttaaccgggttagtacccggtaaccgtacggtaaccctaacccgtagttaccgtcgtttaacccg

SEQ ID NO: 279662 - DNA, 634 bp, Homo sapiens
  misc_feature: GYAE6OF02HGFCU.48.43.D10.1.454.CMB.1.raw
  modified_base (209)..(209): a, c, t, g, unknown or other
  misc_feature (209)..(209): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttcgacccagtctccatcctcctgtctgcatctgtgggagacagagtccaccctnacttcgccgggcaagtcaggcctattccaattcttacgcctgtatcagcaagaaacaggacaactcctacactactgtactactatgatacgcgtactaggtttagaggtaggtacggggaccccagtacggacggtacaggtcggacgaggtgacgtacgaagggacgacgtagtaccactctaccgaacctactacgacgacgacgtccgtagcgacgtaccgtaagtaagttacgttttacgaccttaacgttaacttactacgtaacgtaaacctaaactttaaactaaacctttaccctacgtaacgtaacgtacccggttacggaccgaacggaccgtaacgggtaaccgaaaccggtaacgtaacggtaaccgtacggtacgacgttaccgaccgtacccgtacgttcgtacgttacc

SEQ ID NO: 279663 - DNA, 684 bp, Homo sapiens
  misc_feature: GYAE6OF02HLSLR.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagacgtcaccctcacttcggccgggacaagtcacggtcctatttccaatttctttagcctggtatcagcaagaaaccaggacaaactcctacactcctgatctatgatgtccgtacctagtttagagtaggtcggggccccagtcggtaggttcgaggcggctaggttggacgttacgaggggaacaggtcgttaccgacttccgtacacctactcaacgcctacgacccttgaccgtacgacccgttaggtaaagttacgtttttacgaacctttaaactttacgtttaaccgtacgtttaacctaaacgtttaaaccttttaaaaccaacccttttaacccctaactaaccgttaaacggtccccgtttaaccgggaacccggtaaccgggtaacccgtaacggggttaacgaaaacccggacggtaaccggtaaaccgttcgggtacgtacgtaccgaccgtaaccctcgttaccgtcttaccg

SEQ ID NO: 279664 - DNA, 534 bp, Homo sapiens
  misc_feature: GYAE6OF02HHBE9.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctggtatcagcagaaaccaggacaaactctacactcctagatctatgatgccgtctagtttagagaggtcggggcccagtcgaggttcaggcgcgtagtggatcgagggacagagtcactctcaccatcagcacgcctgcacgcctagaagtattttgacttaacttattactagtaactaaagttactactacctttcgaccctatacctaccgttcgaccaaggacacgtacgtaggaactaacgtaaacgtacgtaggtacgtcgtacgacctacgacttcttacg

SEQ ID NO: 279665 - DNA, 678 bp, Homo sapiens
  misc_feature: GYAE6OF02IUHWJ.48.43.D10.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgaccgtccagttcgacccgagtctccatcctccctgtctgctatctgtgganacagagtcaccctcacgtcgccggcaagtcaggcctattccaattcttagcctgtancagcagaaaccaggacaactacctaacacctctagactctataggatcgacgtctaggtttaagagtggtcgggacccctagtcggaggttacacggtcggacgtaggtaggtacgtacggaacgggacgtaaggtaacgttcgacccttactaccgtaaccactaccgacgcgtaccgacttcgacgtaccgcgttaacgtaagttacttttacgaacgttaacttaattaccgtacttacctaaacgttaactttaaacctaaccttaaacccttacgtaaccttaaacggttacccggttaacggtacccgaaaccgggtaccgtaacgggttaaaccggaaaccggtaaaccggtaaccggtaaccgtttacggaccggttagtaccggttaccaacccgttactaccgttgtttaaccc

SEQ ID NO: 279666 - DNA, 805 bp, Homo sapiens
  misc_feature: GYAE6OF02JBTGW.48.43.D10.1.454.CMB.1.raw
  modified_base (617)..(617): a, c, t, g, unknown or other
  misc_feature (617)..(617): n is a, c, g, or t
tcagagtatacatacacgaccggtgctcgatttagactagcagtaagggggcaggagtcagacccactcaggacacagcatggacatgagggtccccgctcagctcctggggcttctgctgctctggctccaggtcgccagatgtcgacgtccagttcgaccctagtcctccatccctcctgtctgcattctggtgggaagacaggtacgtcctaacccctgtaccgttcggccgggactaacggtccgaacggtacccttaacgttttaccgtaacgttttccgtttacgccgttagggttactaccgaacggaccgtaaacggtaaaacccgtaacgggtaacctaaaaccttcccgtaaccgtaccttacccgtaggtaacttaccgttagtacgtacgtcggtaccgttacgtaaggtttacggacggtacgggtccggggtaccctaggttaccggtacggttaccgacgggtaccggtacgtaggtggtaacgtacggtaacgggtaacgtacggtacgttacctaccttaccgtacctaaccgtataccgaagtaccgacgtccgtacgcgtacgtccgtagtaacgttaacgtttcgaacttaacgttnttaaccgtagtaaacctaacttaactttaaccgtacttaaccctaagtaaccgtaacgttaccgtaaccgggtaccgtaaaccgggttacccgaacgggtaaacccgtaaacggtaaacgtaaccggtaacgttaccgggtacggtaccgtaccgtacccgtaactacggttccctacgtttaacccg

SEQ ID NO: 279667 - DNA, 774 bp, Homo sapiens
  misc_feature: GYAE6OF02I2TQW.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggacaagtcacggccatttccaattcttagcctggtatcagcaagaaaccaggacaaactctacactcctgatctatggatcgcgtcctaggtttagaggtacggtcggggaccctagtcggtacggttacgaaggcgggtacgtaggtacgggagttaccggaacggggtaacgacgggtaacgttttaccgaacgtttcccgtacctaacccgtaacgttaccgaaacggtccgtaaacggcccgttacggacccgtaacgggtacccgttagggtaaacgttagttttttaccggaactttaaaaccgtttactttaaccggtttaccgttaaccgtaaaaccgtttaaacccttttaaaccgtaaacccttttaaaccccttacgtaaaccgtttaaccgggtaccccgtttttaccgggtaaacccgttaaacggggtaccccgtaagggggttaaccggaaaacccggtaaacggaccggttaaacgttaccgggtacggggtacccttacggaacccttaaccgtacgtttacccgttacggttttacccg

SEQ ID NO: 279668 - DNA, 533 bp, Homo sapiens
  misc_feature: GYAE6OF02G7216.48.43.D10.1.454.CMB.1.raw
  modified_base (100)..(100): a, c, t, g, unknown or other
  misc_feature (100)..(100): n is a, c, g, or t
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagagtatacatacacgaccggtgctcgatttagactagcagtaaggggggcaggagtcagacccactcaggacacagcatggacatgagggtccccgntcagctcctggggcttctgctgctctggctcccaggtnccagatgtgacgtccagttcgacccagtcctccatccctccctgtctgcatctgtggganacagagtccaccctcacttcggccgggcaagtcaggcctatttccaattctttagcctggtatcagcaagaaccaggaacaactccacactcctanactctatgatcgccgtctagtttagagacggtcggggacccagtcgaggttcgagcggnaggtgatacgaggacagtagtcactctacacactcagcacgcctgaccacgcctagaagttctttacgacttacttattactagttacaacttactttaaacacttacctatactacgtccgtacgacgaacggacctaggacgaaacacgacgacgtgtcgctagccacgacttctctc

SEQ ID NO: 279669 - DNA, 569 bp, Homo sapiens
  misc_feature: GYAE6OF02F23UC.48.43.D10.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctcctgtctgcatctgtggganacagagtccacctcacttgccggnaagtcaggccatttccaattcttagcctggtatcagcaagaaccaggactaaactcctacactcctagactctatgatcgcgtcctagttaggagtacggtcggggcccctagtcgtaggttcaggcgcgagtggatcgaagggacagacgttcactctacaccatccagcacgcctcgacacgtaccgtagtaagttctttgactaactttatactcgtactaactaactttaaacacttaccctataacgtaacgtcccgttacgacgtaacggtacccgtaggtaccggaaaccgaagtaccggaaacgtcggtacgtccgttagacccacgtacttccgtagttaccc

SEQ ID NO: 279670 - DNA, 554 bp, Homo sapiens
  misc_feature: GYAE6OF02FG11S.48.43.D10.1.454.CMB.1.raw
  modified_base (338)..(338): a, c, t, g, unknown or other
  misc_feature (338)..(338): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtccaccctcactttcggccgggcaagtcaggcctatttccaattctttagcctggtatcagcagaaccaggacaaactcctacactcctagatctatgatgcgtcagtttagagagtcggggcccatcgaggttcagnggcagtggatcgagggacaggagttccactctcaccatcagcacgcctncagcctgaagttntttagacttaaacttatttactgttaacctaactaactttaactaactttaccctataacgtaacgtccgttccggtaccgtaacgggacccaagggtacgaaaccgagtaaccgaacgtcgtacggtctcggacctaccattacctgtttacc

SEQ ID NO: 279671 - DNA, 595 bp, Homo sapiens
  misc_feature: GYAE6OF02G8ZUL.48.43.D10.1.454.CMB.1.raw
  modified_base (222)..(222): a, c, t, g, unknown or other
  misc_feature (222)..(222): n is a, c, g, or t
  modified_base (420)..(420): a, c, t, g, unknown or other
  misc_feature (420)..(420): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctgtgggagacagagtccaccctcacttggccgggnaagtcaggcctatttccaatttctttagcctggtatcagcaagaaaccaggaacaaactcctaacactcctgactctatgatgcgttcaagtttagagtcggtcggggcccatcgtaggttcacggcggtacaggtgatcggagggacagtagttcactctcaccagtccacgcacgtcctgcacgaccgtgaagttntttagaccttaaactttattactacgtactaaccttaactttaaaccaacctttacccttaacaacgttaacgtccgttaccggaaccgaacgggtaccccgtaagggtaaccggaaaccgaaggtaaccgaacgttcggtacggacttaccgaccaaccctcttcgtacgttcc

SEQ ID NO: 279672 - DNA, 655 bp, Homo sapiens
  misc_feature: GYAE6OF02IFGZ4.48.43.D10.1.454.CMB.1.raw
  modified_base (195)..(195): a, c, t, g, unknown or other
  misc_feature (195)..(195): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtggganacagagtcaccctcacttgccgggcaagtcaggccatttccaattctttagcctggtatcagcagaaaccaggaacaaactcctacactcctgtatctatgatgctcctagtttagagtacggtcggggacccagtcggaggttcagcggcagtaggatacgagggacaggagttacactctacacactcgaagcacgcgtagcacggtcctagaaagttacttttacgacttaacttttacgttactagtacgtaaaccttaaacgttttaacctaacgtttacccttactaaccgtttaaaccggtcccggtttaccgggaacccgtaaccggggtaaccccgtagggttaaacccgggtaaaacccgtaaaccgggaccggttaaacccgttacgggttaccgggtaccgttacgtaacccgtaacccgttaacgtttccccgttagtttaaccccg

SEQ ID NO: 279673 - DNA, 564 bp, Homo sapiens
  misc_feature: GYAE6OF02G70QW.48.43.D10.1.454.CMB.1.raw
  modified_base (99)..(99): a, c, t, g, unknown or other
  misc_feature (99)..(99): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
tcagagtatacatacacgaccggtgctcgatttagactagcagtaagggggcaggagtcagacccactcaggacacagcatggacatgagggtccccgntcagctcctggggcttctgctgctctggctcccaggtgccagatgtgacgtccagttgacccagtctccatcctccctgtctgcatctggtgganacagntccaccctnactgccggcaagtcaggccatttccaatttcttagcctaggtactcagcaagaaaccaggaaccaaactcctacactcctagatactatgatgcgtactagtttaggagtacggtcgggaccctagtcgtagtcagcgctaggtgatcgaggacaggtcgttacnctctcaccatacgancanccgtgcacgtctagattctttagcctaatttatacgtacgtactaaaccgttaactttaacacctttaccattacgtaacgtaccgttaccggaccgtaacggacccaaggggtaacaaaccggaacgtacggtacacggtcggtactcaccgtaccactttcgtagttaccc

SEQ ID NO: 279674 - DNA, 586 bp, Homo sapiens
  misc_feature: GYAE6OF02F9PGT.48.43.D10.1.454.CMB.1.raw
  modified_base (501)..(501): a, c, t, g, unknown or other
  misc_feature (501)..(501): n is a, c, g, or t
  modified_base (566)..(566): a, c, t, g, unknown or other
  misc_feature (566)..(566): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagacgtccaccctcacttgacccgggcaagtcacggcctatttccaattcttacgcctggtatcagcaacgaacagaacaactccactactcctgatctatgactcgtcgtacctagtttagagtacgggtcgggcccctagtcggtaggttcgacgcggtacgaggtggactacggaagggacagtacgttaccactctccaacgactcgaagtcacgcgtagccaacgtccgtaagtaacgttactttcgaacttaacttattacctacgttactaaaccttactttaaactaacttaacctnaaacgttaccgtcgtacgaccgaacggaccgtaggaacgaacgacgtacgtaagtcgtagtaccncgaaccgtcactctgttacc

SEQ ID NO: 279675 - DNA, 690 bp, Homo sapiens
  misc_feature: GYAE6OF02GPEEE.48.43.D10.1.454.CMB.1.raw
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttcgacccagtctccatccctccctgtctgcatctggtggganacagacgtccaccctnacttcggccgggcaagtcacggcctatttccaattcttagcctggtatcagcaagaaaccaggaacaactcctacactcctgactctatgatcgtcgttactaggtttagacggtacgggtccggggaccctagtcggtacggttcgacggacggcgtacggtggtacgtacggtaacggggaactaagggtacgtttaccgaccttaccgtaccaaccctactaccgacggtaccacggtccctaggaccacggtaccgtaggtaacgttacgtttacgtacgtttaactttattaccgttacgtaaccttaaaccgttaaaccttttaaacgtaacctttaccctaacttaaacgttaccgttaccgggttaccggaacccggaaccggtacccgtacgggtaaccgaaacccgtaacggacgtaaaccgttcggaacgtaccgtacgaccttaccgtcttacttccgttaacc

SEQ ID NO: 279676 - DNA, 683 bp, Homo sapiens
  misc_feature: GYAE6OF02GULS2.48.43.D10.1.454.CMB.1.raw
  modified_base (285)..(285): a, c, t, g, unknown or other
  misc_feature (285)..(285): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtccaccctcacttgccgggcaagtcaggccatttccaattctttagcctggtatcagcaagaaccaggacaaactcctacactcngatctatgatcgctacgtagttagagtacggtcggaccctagtcggtagttcgacggcgacgtaggtacgacgtacggaacgggtaacgtaggttaccggttactaccctaccgttaacccgacccttaacgtaccgaacgtaccgtaaccgttcccgtacgaccgtaccggtaccgttagggtaaacgttttcgtttaccgtaacctttaaacgttttaacttaccgtacttaaccgtaaacctttaaacgtttaaacctacctttaacccgtacttaaacggtaaccgttacccggttaccgaaccgggtaccggtaccgtagggtaaaccggtaaaccgaacggtacccgtaagttcggtacgtaccgtcgaaccgtaccacgttcgtacgttac

SEQ ID NO: 279677 - DNA, 532 bp, Homo sapiens
  misc_feature: GYAE6OF02GHFCQ.48.43.D10.1.454.CMB.1.raw
  modified_base (446)..(446): a, c, t, g, unknown or other
  misc_feature (446)..(446): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattcttagcctggtatcagcagaaaccaggacaaactcctacactcctgatctatgatgctccagtttagagagtcggggccccagtcgaggttcagcggcaggtggatcgagggacagagttcactctcaccactcagcacgcctgacagccgtagaagtattttgacttaacttattactgtacaactactttaacaacttaccctanaactacgtccgtcgaccgaacgggaccaggtacggaaacctaaggacgtaacgtagtaggctacgacctacctacgtactgttacc

SEQ ID NO: 279678 - DNA, 686 bp, Homo sapiens
  misc_feature: GYAE6OF02GG1RT.48.43.D10.1.454.CMB.1.raw
tcagagtatacatacacgaccggtgctcgattttagactagcagtaagggggtcgtaggttggtagatcgccctctgggagagatccccaggggtgacagccagtcggaccctggaagggcctggggcgtagggacaggggaccagacgccaggtccagggagaggacagagccaatggactggggtgtactgtaacacgcctgctggcgagacgggaccagggcaccgtcctccgagggacgcccatgctggacgaacggtcggaccgaggacggtcgccccgtgaaccgtagtaacggaccaacgtggacgaacccaaggaaccaacggaccgtaagggtgggttacgtcgaacgaccccggtaggacggtacgtcgttcgggcccgttcggtacccagggacacggccggtcgtacgggtccccgtcggtccgtcgtccgtcggtcgtcggggtactcggcgacggtcgtaccgccgtaggtccgcgtcgtactcgccgtccgtaagtcggtcaccggtaccgacggaaccggccgggaacccacggccggtacggcgtcctcggtacgtacggacgcgacgaccgactcgacgcgtcggacggtcgcggtcgggcggcggtacgtccgtacggaccgtaacgccgtaccggtccgtacggcctccgttccgtaccttccccg

SEQ ID NO: 279679 - DNA, 605 bp, Homo sapiens
  misc_feature: GYAE6OF02F28MI.48.43.D10.1.454.CMB.1.raw
  modified_base (214)..(214): a, c, t, g, unknown or other
  misc_feature (214)..(214): n is a, c, g, or t
  modified_base (312)..(312): a, c, t, g, unknown or other
  misc_feature (312)..(312): n is a, c, g, or t
  modified_base (438)..(438): a, c, t, g, unknown or other
  misc_feature (438)..(438): n is a, c, g, or t
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttgacccagtctccatccctccctgtctgcatctggtggggagacaggagtccaccctnacttggccgggacaaggtcaggcctatttccaatttctttagcctaggtatacagcaacgaaacaggaactaaacctctaactactctagtatctatnatgcgtactagttagagaggtcgggcccagtcgacgttcaggtcgcgtagtggtagtacgagggacagtacgtcactctacaccatcagcagctgcacgtcgtagtaatgtttacgactaaacttnttactgtactaaacctaatttaaccgaaacttaccctaactaacgttaaccgtacccggtttaccggaaccgtaacggggacccctaaagggtaaccgtaaaacccgaaggtaaccggaaacgttggtaccgtacgtcgaaccaaccgttacttaccgtcgttaacc

SEQ ID NO: 279680 - DNA, 574 bp, Homo sapiens
  misc_feature: GYAE6OF02JJ1ID.48.43.D10.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctcctgtctgcatctgtggganacagntcacctnacttgccggcagtcagcattccattcttagctggtatcagacagaacagacaactccacactctcgactactatagatgcgtctagtttagagtaggtcgggcccagtcgtagtcgagcggctagtcggagtcgaagggactagacgttacacgttcacgtaccatcagtacacgcctgcgacgtcgtagaacgttatttacgactaacttacttacgtcgttacaaacttacttaactaacgttacctacgtaacttaccggttaccgtaccggaccgaaaccggtaccgtaacgggtacggaaacccgtaaggtacgttaaccgtggttacgccgtaccgaccgtaaccacttgttaccttacccg

SEQ ID NO: 279681 - DNA, 702 bp, Homo sapiens
  misc_feature: GYAE6OF02GG8W9.48.43.D10.1.454.CMB.1.raw
  modified_base (136)..(136): a, c, t, g, unknown or other
  misc_feature (136)..(136): n is a, c, g, or t
tcagagtatacatacacgaccggtgctcgatttagactagcagtaagggggcaggagtcagacccactcaggacacagcatggacatgagggtccccgctcagctcctggggcttctgctgctctggctccaggtnccagatgtgacgtccagttcgacccagtctccatcctccctgtctgcatctgtcgggagacagacgtccacctcacgttggccgggacaagtcacggacctatttaccaatttctttaacgtccgttaggtactcacgctaacggaaccaaggactaaactcctaacaccgttcctagtactactatagtatcgtacgttacctaaggtttagacggtacggtcggggtacccctaagtcggtaacggtttcgacggcgggtcgtaaggtggaacgtcgaagggacgtaggtacttcgacttcgtacctaactactaccgaggaccgtacggacccttggaccaacggtccgtaaggtaacgtttaaacgttttacaacccgttaagttttacctaacggtttacgtaacctaaacgttaccttttaactaactttaacccgtacttacgtaacggtcccggttacggacctaacgggtaccctaggttaaccggaaacctaagtaccggtaacgtacgggtacggttactaccggacccgttaagtcgttaccgttcttaacccg

SEQ ID NO: 279682 - DNA, 612 bp, Homo sapiens
  misc_feature: GYAE6OF02F3LCB.48.43.D10.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
tcagagtatacatacacgaccggtgctcgatttagactagcagtaaggggggcaggagtcagacccactcaggacacagcatggacatgagggtccccgctcagctcctggggcttctgctgctctggctcccaggtgccagatgtgacgtccagttcgacccagtctccattccctcccgtgtcctgctactcgtgtggganacagagtccaccctnacgtcgccgggnaagtcaggcctatttccaattcttagcctaggtancagcaagaacgagaacaaacgtcctaacactcctagactctataggtactcgtacgtccgtaagttaacgagtacggtccgggggaccctaggtcggtacggttcaaggtcggacgaggtggactcggaggtacagtacgttcactctacacgatcagctacgctacgcgtacgctaggtaacttagtttacacgtaaccttatactcgtaactaaactacttaataaccttaccgacttaacgtaacgtaccgttacggaaccctaacgggacccgtagggtaaccgaaacgaacggacgtaacgtacggtagtcgttacgacgtaaccacgttacgtcgttaccg

SEQ ID NO: 279683 - DNA, 790 bp, Homo sapiens
  misc_feature: GYAE6OF02FOCLJ.48.43.D10.1.454.CMB.1.raw
  modified_base (192)..(192): a, c, t, g, unknown or other
  misc_feature (192)..(192): n is a, c, g, or t
  modified_base (224)..(224): a, c, t, g, unknown or other
  misc_feature (224)..(224): n is a, c, g, or t
tcagagtatacatacacgaccggtgctcgatttagactagcagtaagggggcaggagtcagacccactcaggacacagcatggacatgagggtccccgctcagctccgtggggcttctgctgctctggctcccaggtgccagatggtcgacgtccagttcgaccctagtctccattccctccctgtctgctntctgggtaggacgaacaggacgtcctaccctntaccgttcggccgggtacgaacgtcgacggccttaactttacctaatttcgtttacgccgttggtaattcgagaccgaaacgtaaaaccgacggaaacctaaacctacccgtaaacacccttaccgtacgtaacgttactttaggtagtaacgtccgtccggttaacctaagggttttaacggacgggttaccgggtccccgggggttaacccctaggttacccggggtaacggttacggtacggaccgggtcgtaacgggtggacgtacgggaaacgggtaacaccgggttaagttcccgtaccttaccgaccgtaaccgtacgtaccgtacgacccggtaacgtcgtacgccgttaacgcgtaaaggttatttgttacaacccgttaattacttacgtacgtaacttaaccttaaaccgtttacctaaaccgttaccgtataaacgttaccgtaacccggtacggtacccgtaaacggtccgttaacggaacgaaacggtaacgtaaccggtaacgtacgggtaccgtccgacgtacccggtaactcgtttaccgttctaaccc

SEQ ID NO: 279684 - DNA, 666 bp, Homo sapiens
  misc_feature: GYAE6OF02FT4A3.48.43.D10.1.454.CMB.1.raw
  modified_base (198)..(198): a, c, t, g, unknown or other
  misc_feature (198)..(198): n is a, c, g, or t
  modified_base (649)..(649): a, c, t, g, unknown or other
  misc_feature (649)..(649): n is a, c, g, or t
tcagagtatacatacacgaccggtgctcgatttagactagcagtaagggggcaggagtcagacccactcaggacacagcatggacatgagggtccccgctcagctctggggcttctgctgctctggctcccaggtgccagatgtgaccgtcagttcgacccagtctccatccctccctgtctgcatcgtggtaggganacagtactccaccctcacttcggccggtacaagtcaggtcctatttccaatttcttacgcttggtactctacggacaacgtaacccgaaggaactaaacctaccgtaacctaccttaccgttagacttacgtactaggaacttcggtacgttacccgttaaggtttaaggtacgtacggttaccggggaccctaaggttccggtaacggttacgtaacggcggtcgtaggttacggtaacgtacggaacggggtaacgtaacgtacgttaccaccgttacgtaccaaccctacgtacgacgacgacgtaccgtcgacgtaccggtactaacgtaagttattcgtaacttaacgttacgtactactactacttaaaccttactaaccttcgtactagtacgtccgtacgaccgacgacgacgtacgaacgacgataccgtgcgtcgacgtanacctagttcctagtacc

SEQ ID NO: 279685 - DNA, 905 bp, Homo sapiens
  misc_feature: GYAE6OF02IW6GO.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtcgccagatgtgacgtccagttgacccagtcctccactccctccctgtctgctattcgtggtagggatacgagtacgtccacccgtctacgttcggcccggacaacgtcgacggaccttatttaccgtaactttctttacgccgttaggtatcgacgacaacggtaaaaccgaggtaaacctaaacccttacctaacctaccgttaccttagtaaccttacgttacgtagtacgttccggtaccggttaccgttaagggttttaaggacgggtacgggttaccccggggtaccccgtacggttacgggtaaccggtttaccggaacggtaccgggtacggtacggggtacggtaacggtaccgggaaacggggtaacctaacgggttaaacggtttccctaaccggttccttaccgtaacccgtacgtaccggaacgaccctacgggttaccctacggacgttaaccgtccggttaacgttaaacggtttccgtttacgttaaccctttaaacgtttaccgtttacgttaccggttaaaaccttaaacccgtttaaacccgtttaaaccctttaaaccgttacccccttaacgttaaacccgttacccgggtttaacccggtaaccggggtaaccccgtaaaccggggtaccccgggtaaccgggtaaacccgggaaacccgttaacccgggaccggttaaacgttacccggggtagtaacccggttaccgtacccggttaacccgttcgttacccgttacggtttaccc

SEQ ID NO: 279686 - DNA, 807 bp, Homo sapiens
  misc_feature: GYAE6OF02IIPZN.48.43.D10.1.454.CMB.1.raw
  modified_base (118)..(118): a, c, t, g, unknown or other
  misc_feature (118)..(118): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
tcagagtatacatacacgaccggtgctcgatttagactagcagtaaggggggcaggagtcagacccactcaggacacagcatggacatgagggtccccgctcagctcctggggcttcngctgctctggctccgaggtgccagatgtgacgtccagttcgaccctagtctaccatcctccgtgtctgcattctggtaggganacgagtacgtccaccctcgtacgttcggccggtanaacgtccgaacggtcccttagtttaccctaattttaccgtttacggacccttagggtacttacgacgacgtaaacgaaaccgtaacggaccaaaccgttacctaacctaaccttccctacgaacgtttaccgttaagtacggtaactacggtccggttaaccttaagggttttaacgggaacgggtaccgggtaccgggggacccccttaagggtacggggtaaacggttccgggaagggtccgggtcggtaaacggttcgggtaacgtaacggggtacgggaactaaacgggttaccgttaccgtaccgttcccgtaaccgtaacccgtacgtacgaacgaccggtacgccttaacggaccgtaccgtaccggtaaggtaacgtttacgtttacggtaccttaactttaaacgttacgttacgttacctaaacttaaccttaccttaaccttacctacttacgtacgtccgttaccggaaccgtaaccggtacggtaaccgggtaagtaaccgaacggacggtaacgttcgtagggaccctagaccgtacgtaacgttcctacgtttccc

SEQ ID NO: 279687 - DNA, 569 bp, Homo sapiens
  misc_feature: GYAE6OF02F8YZS.48.43.D10.1.454.CMB.1.raw
  modified_base (353)..(353): a, c, t, g, unknown or other
  misc_feature (353)..(353): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgccatctggtgggagacagagtccaccctcacttgccgggcaagtcaggcctatttccaattctttagcctggtatcagcaagaaaccaggaaccaaactcctaacacctacctgatctatgatcgcgtcctagtttagagaggtcgggccccagtccgaggttcacggcgngagtcggagtcgagggactagtactttcgactcgtaccaactactacagcacgctcgactacgccgtagaagtntagttnactaactttattacgtntacaactagtacgttaacgttaacttaacccttacgttacctaacgttttacgaccggtacgggaccgtaggtaggaacgtactaacgaacgtagtggtcggcttacgcgtacctatcg

SEQ ID NO: 279688 - DNA, 678 bp, Homo sapiens
  misc_feature: GYAE6OF02HLTBG.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctggtgggagacagacgtccaccctcacttcggccgggacaagtcgaggcctatttccaattctttagcctggtatcagacagaaaccaggacaaactcctacactccagatctatgatgccgtctagttagagtaggtcggggccctagtcggtaggttcgaggtcggcgtacggtggaacgtcgaacggggaacgtaaggtacggttacctaccgtcctaccaacctacgtacctaacggacgtacgccctaggaccgacggtaccgtagtaacggttagttttacgtacttaaactttaacttaccgttacgttccgaaactaacgttacgtttaaccgttaaaccgttaaccccgtttacccgttaaccgttaaccgttttacggacccggtaacggggtaaccgtaaggggtacggtaacggtaacgtaaccgtaaacgtacgtacggtacggtaccgtacgtacccgtaacctacgttacgttaccg

SEQ ID NO: 279689 - DNA, 727 bp, Homo sapiens
  misc_feature: GYAE6OF02HZFS5.48.43.D10.1.454.CMB.1.raw
  modified_base (194)..(194): a, c, t, g, unknown or other
  misc_feature (194)..(194): n is a, c, g, or t
  modified_base (328)..(328): a, c, t, g, unknown or other
  misc_feature (328)..(328): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtcaccctcacttgccgggcaagtcagggcattagaagttattagcctggtttcagcagaaaccagggaacgacccctaaatcctagactctacgctgacatcctacttgcactacggtgggttccctntacggttcacggtcggcgacgcggtatcgtagggaacagtactttcactccgtaccacctattacgacgtacacgacccgttgaccgtacggtacctaggtaaagtacgttacggtttagaaccgtttaaaccttttaacgttaacgtttaaccgtaccgtaaaacgttacgttaaccgtttaacggttaaacccggttaacccccgttaacccggtttaaccctttaccgggttttttaccggaacccgggtaaaaccgggggttaacccgtaacgggttacgggaacgtaaccggttaaacccggtaaaaaccggttaaccggttaacgggttaccggtaccgttaccggaccgttaacccgtaaccgtttacccgtttacggtttacctttacccg

SEQ ID NO: 279690 - DNA, 805 bp, Homo sapiens
  misc_feature: GYAE6OF02FZENY.48.43.D10.1.454.CMB.1.raw
  modified_base (100)..(100): a, c, t, g, unknown or other
  misc_feature (100)..(100): n is a, c, g, or t
tcagagtatacatacacgaccggtgctcgatttagactagcagtaagggggcagggagtcagacccactcaggacacagcatggacatgagggtccccgntcagctcctggggcttctgctgctctcggctcccaggtgccagatgtgacgtccagttcgacccagtcctccatccctccctgtctgcatcgtaggtgggaagacaggacgtccaaccccgtcacgttcggacccgggactaaacggtcacgggtcctaacgttttcctaagttttcctttaacgccttaggtaactacgagaccaacgaaaccgaacggtaacctaaaccgtcccctaacctaccttccttacggtacttacctagttaccggactcgtaccgttaccgtaagtttacgaacggtacggtaccgggggtccctacggttacggtaacgttcgacggcggtaccgtaggtggacgtacggaggtaccgtaaggtaccttacctaccgttacacgtaacctacgtacgaacggctaacggtccgtacgtacgtacggtaccctaggttaaacgtttacgtttacgaactttaaccgtttattaccggtacgttaaccgtaaacttaaccgttttaaaccgtaacctttacccgttaacgttaacggttaaccggttacccggttaacgggaaccggtaaaccgggttaccgtaaacggggtaaaccggaaaccggtaacggtaaccggtaaccggtttacgggtccggttaccggtccgaaacccgttaacgttccgtttacgttacgtttacccg

SEQ ID NO: 279691 - DNA, 944 bp, Homo sapiens
  misc_feature: GYAE6OF02IGO7K.48.43.D10.1.454.CMB.1.raw
tcagagtatacatacacgaccggtgctcgatttagactagcagtaagggggcgaggagtcagacccactcaggacacagcatggacatgagggtccccgctcagctctggggcttctgctgctcgtggctccgaggtcgaccagatgtcgacgtccagttcgaccctagtctccactcctccctgtctacgcattcgtggtagggacacagtacgtcacctctacgttcggaccggacaacggtcgaggtacctaagtttaccgaaattttccgttttaacggaccgtttagggttaactcggtaacgaccgaaaacggaaaaccgtaacggtaaaccctaaaaccttccccgttaaaccgtaaccttaccccgttaaggtaactttaccggttaaacttcgggtacgttaccggtaccggttttaaccgttaagggtttaacggacgggttacgggtaccccgggggtacccctaaggtaccgggtacggttaccgaaggcccggggtacgtaggtagggtaacgtcgggtaaggggaaacctacgggttaacctttaccctaaaccggttcccgttaaccgaacccgttaagttacccgaaaacggttacccgtaacggtcccgtacgggtacccgtaaccgggtaccgttaaaggtaaacggtttttaccgttttaccgaaaccttttaacgtttacttaacggtaacgttaaacccgtaaaaccggttttaaacctttaaaccgttaacccgtttaccccgtaacgttaaaccggttaacccggtacccgggtttaaccgggaaacccggaacgggttaccccggggtaaaggttaaaccccggtaaaaacctaccgggtaaacggtaaaccggtttcggaaccgggtttacccaaacggtaccccgtaaactttaccggtttccttaaccgggttaccc

SEQ ID NO: 279692 - DNA, 789 bp, Homo sapiens
  misc_feature: GYAE6OF02HSMPF.48.43.D10.1.454.CMB.1.raw
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
tcagagtatacatacacgaccggtgctcgatttagactagcagtaagggggcaggagtcagacccactcaggacacagcatggacatgagggtccccgctcagctcctggggcttctgctgctctggctccgaggtgccagatgtgacgtccagttcgacccagtctcatcctcctgtctgcatctggngganacagcgtcacctnacgttcggccggataagcgagtcctattcctaattcttagcctggtactcgagcaacgaaccgaggaacctaacgtacctaaccacgtacctagacttacagtacgagtcgtccgtaccgtaggttacgaggtcggtacggggacccctagtcgtacggttcgacggcggacgtaggtacggacgtacggaacggggtacgaaacggtacgttaccgtacgttacctaccggtaaacctaggtaacccgaaggaccctaaaccggtcccggtttacggaaccctacgggtaccccgtaagggttaaacggttaacgttttacgtaaacgttaaaccgtttaacgttttaaacgtccggttaaaccgttaaaccgttaaaccttttaaaccggtaaacccttttaacccgttaaccgtaaccgtttaaaaccgggttccccgggtttaaaccgggaaccgttaaccggggtaacccggtaacgggttaaacggaaacccgggtaaacggtaacccggtaacgttaccgggtacgttaacccgtcggtaaaccctaccgttaacgttcccggttacgttaacccg

SEQ ID NO: 279693 - DNA, 733 bp, Homo sapiens
  misc_feature: GYAE6OF02GSYN5.48.43.D10.1.454.CMB.1.raw
  modified_base (99)..(99): a, c, t, g, unknown or other
  misc_feature (99)..(99): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
tcagagtatacatacacgaccggtgctcgatttagactagcagtaagggggcaggagtcagacccactcaggacacagcatggacatgagggtccccgntcagctccgtggggcttctgctgctctggctcccgaggtcgccagatgtgaccgtccagttcgaccctagtcctccattccctccctgtctgcatcgtggtaggganacagngtccacccgttcacgttcggacccgggataacgtcgaacggccttaacgtttaccaattttcgtttacggccctttaggtaactcgacggtacaacgtaaacccgaaggaacctaaaccgtcctaactacctccgttagaacttctatagtactcgacgttacgtacgttagacggtacggtccggaccctaggttacgacggttacgacggtcggacgtaggtacgacgtacgaacgggtaactagtaccgttccgaccttacgtaccgaactacgtacacggccgtacgtccgacgcgaacgtaccgtagtaagttactttcgaaacgttacttaacttactcgtaaaccttaaccttaaacgtttaacctaacccgttttaaccaccgttaaacgtaccgtaccggttacccggtaaccgtaaccggaccgttacggtaaaccggaaacccgtaacggtaccgtaaaccgtcggtacgtaccgtacgtaccgtaccgttacgtacgttacgttaacccg

SEQ ID NO: 279694 - DNA, 752 bp, Homo sapiens
  misc_feature: GYAE6OF02HB3Q4.48.43.D10.1.454.CMB.1.raw
  modified_base (204)..(204): a, c, t, g, unknown or other
  misc_feature (204)..(204): n is a, c, g, or t
  modified_base (489)..(489): a, c, t, g, unknown or other
  misc_feature (489)..(489): n is a, c, g, or t
  modified_base (576)..(576): a, c, t, g, unknown or other
  misc_feature (576)..(576): n is a, c, g, or t
tcagagtatacatacacgaccggtgctcgatttagactagcagtaagggggcaggagtcagacccactcaggacacagcatggacatgacgggtccccgctcagctccgtgggcttctgctgctctggctcccaggtgccagatgtgacgtccagttgaccctagtcctccattccctccctgtcttagcatcgtggtgggaanacagtacgtccaccctcacgttcggcccgggacaaacggtcgacggtccttacgttttacctaattttacctttacgtaccgttaggttaacttccgacgtaccgaaacggtaaaacccgaggtaaaccctaaaccgttccctaaccgaaccttcctagtacttactacgttaggacttccgtacccgttacgttaaggtttaggacggtacgggttccgggccccttaaggaccggttacggttcgaacgggcgtacggtaggtaggacgtacggaccggtaanacggttacgtcctaacctacgtcctaacctcgtaccgacgcgtaccgtcctacggtaccacgtaccgtagttaaagttacggtttanaccgttaagtttacttacgtactaaccttaacttaaaccgtttaactaaccgttacctacgtacgttaccgtacggtaccggaccggtaaccgtaccgaacgggtaaccgtaaaccggtacgtaccgtagtaccggttacgaccgtaccgaccttacgtacctcgttacgttaccc

SEQ ID NO: 279695 - DNA, 604 bp, Homo sapiens
  misc_feature: GYAE6OF02GIMNC.48.43.D10.1.454.CMB.1.raw
  modified_base (283)..(283): a, c, t, g, unknown or other
  misc_feature (283)..(283): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctcctgtctgcatctggtggagacagacgtccaccctcacgttcgccgggacaagtcacggcctactttcaatttcttacgccttgtatcagcaagaacagacaactcctanacctctgattctatgagtgtcgtctagtttagaggtacggtccgggaccctagtaccggtaggttacgacggtcgggactacgggtggactcggaaggggtacaggttacgttactaccgtctaccgaccagtcacgtacacgtcgtcgacgtacgaccgtacggtattacgtttacacgtttaacttacgttatacgtacaatttaaccttaacgtaccttacctaacgtacttaacgtccggtaaccgaccgaacgggtcgaacggtacggaaaccacggtacgaacgtggtactcgaccgcaactcgttctgttaccc

SEQ ID NO: 279696 - DNA, 748 bp, Homo sapiens
  misc_feature: GYAE6OF02HJD8Q.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctcatcctccctgtctagcatctggtgganacagacgtccacctcacttggccgggactaagtcaggtcctatttccaatttctttacgccttggtactcgagtacaacgtaaaaccgaggtaaaccaaaccgttcctaaccgtacctaccgttagacttacctaatagactcggtccttaccgtagttaacgaggtacggtaccgggggtacccctagttcggtacgtttacgaacggccggtacgtaggtacggacttacggaacgggtacgtaaggtacgttaccgaacttccgtacctaaccgtacgtaccgaagtcctaacggcccgttagccgtaaccgtaccgtagtaacggttacttttacgaactttaaactttagtttaccgtacgttaaccttaacttaaacctttaaccgtaacctttacccgtactaacgttaaccgtccgtttaccgggaaccgtaaccggggtaaccgtacgggtaacccggtaaaaccgtacgggtaccgtaaaccggtttcggtaaccggttcgttaccggaccgttaacccgtacgtttaccgtacggtttacccc

SEQ ID NO: 279697 - DNA, 707 bp, Homo sapiens
  misc_feature: GYAE6OF02GIE7H.48.43.D10.1.454.CMB.1.raw
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (694)..(694): a, c, t, g, unknown or other
  misc_feature (694)..(694): n is a, c, g, or t
tcagagtatacatacacgaccggtgctcgatttagactagcagtaagggggcgaggagtcagacccactcaggacacagcatggacatgagggtcccgctcagctcctggggcttcgtgcgtgctcgtggctcccaggtcgccagatgtgaccgtccagttcgaccctagtctccatcctcctgtcncgctatcgtggtaggacgacaggtctaccgaccctntacgtcggaccgganagtcgacgtctatttacatttcttgcctgtatcagactaacgtaaccgagaaccgtaaacctccgtaactaccgttacacgtaacttcctaagttacgcgtcgacgttaccgtaagtttacgaacggtccgggtaccggcccttaaggtaccggtaagttccgacggacggtacgtaggtcggtacgttacggacggtacgtaacgtccgttacgtaccaccgtaccaaacgttccgacgtaacgcccgtacgtccgaacgtcgacctacgtaagttacgttacttaccggtacttaacttacgttactaccgttacaaccgtttaaataacccgttattacccgtagtaaccgtttaccgaaccggttccgaacgtaacccgacgtaccggtaaacggtaaacccgtacggaaccgttacgccgtagtccgttaaccgaccttaggtacccgttnttacccgttaccg

SEQ ID NO: 279698 - DNA, 768 bp, Homo sapiens
  misc_feature: GYAE6OF02G60I3.48.43.D10.1.454.CMB.1.raw
  modified_base (177)..(177): a, c, t, g, unknown or other
  misc_feature (177)..(177): n is a, c, g, or t
  modified_base (234)..(234): a, c, t, g, unknown or other
  misc_feature (234)..(234): n is a, c, g, or t
tcagagtatacatacacgaccggtgctcgatttagactagcagtaagggggcagttggtagatgcccctctgggagagatccccagggggtgacagccatggaccctggaagggcctgggctagggacagggaccagagccagtccagggagaggacagagccaatggactggggtntactgtaacagccctgctggcgaggacgggaccagggccaccgtcctccgagggacncccgatcgctgacgaaggtccgggaccaggaggtccgaccccgtagaaccgtaggaacggtaccaaagtggaacgaaccccgaagaacaggaccctaagggtgggttggtacggaacggtaccccgtaggacggtacgcggtacgggtccccgtacgggtccccgaagggccgaacggccggtccgtaccgggccccctggtccgtcggtaccgttcggtccggttcgggggttacccgtacgggaccgtacgttcgggtacccgtacccgtaggttccgggtaccttcggcgtaccggcccgtaaccgtaaggttcggttacgaccgtaccggacgtaaacgggccgggaacccgacggaccggtcggacgtcccgtagtacggttacggagaccgacgtaccgtacaccgagtcccgtaggaccggtacggccgttacggggtcgggtaccgtagggacctaccgggacccgtaacggccgtaacccggtccccggtaccggtaccgtacccgttccgtcccgttacccccg

SEQ ID NO: 279699 - DNA, 851 bp, Homo sapiens
  misc_feature: GYAE6OF02GXDUF.48.43.D10.1.454.CMB.1.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
tcagagtatacatacacgaccggtgctcgatttagactagcagtaaggggggcaggagtcagacccactcaggacacagcactggacatgagggtccccgctcagctccgtgggcttctgctgtctgtggctcccgaggtcgccaggactgtgacgtccagttcgacccagtcctccatccgtccctgtcgtgacattccgtggtggganacagtacgtccacctntacgttcggaccggacaacgtcgacggtaccttaactttacctaaagtttccgttaacgtcccgttaggttaactaccgtaaggaccgtaaacggaaaacctacggggtaaaccctaaacccgttaccctaacccgtaaccgttacccggttagtaaccgttaccgttaagtcggtaacgttacggtaccgttaccgttaaggtttacggaacggttaccgggtaccggggaacccctaggtaccggttaaggttccgaacggtccggttacgacggttacggacgtacggaacgggactaacggtacgtaccgtacgttacctaacgacctaacgtcgtaaccgtaccgaaccggtacgtaccgtacctaacggttacccgtaaggttaaccgttacgtttaaccgtaaccttaactttaacgtacctttacggtaaccgttaaacccgttaaacctttaaccgttaaaccttaacctaaccgttaacgttaaaccggtccggttaaaccggacccggtaaccgggtaccggtaacgggtaacggtaaacccgtaacggtaaccgtaacgttaccggtacgtacgtaccggaaccgttaaccgtagtttccggactttaacccg

SEQ ID NO: 279700 - DNA, 615 bp, Homo sapiens
  misc_feature: GYAE6OF02FLAEQ.48.43.D10.1.454.CMB.1.raw
  modified_base (194)..(194): a, c, t, g, unknown or other
  misc_feature (194)..(194): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatcctccctgtctgcatctgtggganacagagtccaccctcacgttgccgggcaagtccaggcctatttccaattcttagcctggtatcagcagaaaccaggaaccaaactcctacacctacctgatctatagatcgtcgttacctagtttaggacgacggtcggggaccccagtcggtacggttacgacggcggtacgagggtaggagtacggtaaggggactaggtacgttcaccgtctacacctagtcgacgacgacggtcctagccgtacgccctaggaacgttattttacggaacttacgtttaacttactacgtactaaacttactttaaactaaccttacctactaacgtaacgtccggttaccgaccgaaccggtaccaacgggacgaaaccgtagaaccgaactaggtcgtacgacgtaccacgtacgttctgttacc

SEQ ID NO: 279701 - DNA, 761 bp, Homo sapiens
  misc_feature: GYAE6OF02HG9KY.48.43.D10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagagtatacatacacgaccggtgctcgatttagactagcagtaagggggcaggagtcagacccactcaggacacagcatggacatgagggtccccgctcagctcctggggcttctgctgctctggctcccaggtgccagatgtgacgtccagttgacccagtctccatccctccctgtctgcatctggtggagacagtntccaccttcaccttggcccgggtanaacgtcaggtcctacgtttccaagttttccttacgtaccgttggtaactcgtaacgacgaacgaaaaccgacggaaacctaaaccttaccctaaccgtaccttaccctaggtaccttacttagtacgtacgtcggtccgttaccgtaggtttacggacggacgggtccggggcccctagtccggtaaggttccgaaggtccggacgtacggtaggtacgtacggaacgggtaacgtacggttacgttacctaccgtttacccgttaccgaacccttacgtacccgacgtacccggtacgtcccgtacggacctaccggttacccgtaaggtaacgttacgttttacgaacctttaacgttttaaccttaaccgtcggtttaaacctaacctttaacctttaaaccgttaacccttacctacgttaacgttaacccggtacccgttacggaacccgttaaccggacccggtacggtacgaaaccgtacggtacgtaccgtgtcgtacctcgacctaccgtacgttccgtgttaccg

SEQ ID NO: 279702 - DNA, 606 bp, Homo sapiens
  misc_feature: GYAE6OF02IZRY8.48.43.D10.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
tcagagtatacatacacgaccggtgctcgatttagactagcagtaagggggcagttggtagatgcccctctgggagagatccccaggggtgacagccatggaccctggaagggcctgggctagggacagggaccagagccagtccagggagaggacagagccaatggactgggggtgtactgtaacagccctgctggcgagagggaccagggcaccgtccnccagggacncccatgctgacaaggtcgggccaggaggtcgcccctgaacctgaacggccaatgacgaccccaagacaggccaaggtgggttgtgacgacccctggaggagcgtcgggccctggtcccaggcagcgcgtcggcccctgctgctgcgtgggtctcggcngtcggccgcccgagtcggcctgcgtcgccgccagtcggtnccgaccgacgaacgccgggaccacgacctgggacncgtcgagttacggacgtcgacgtccgagtccgngtaccgtgacgggtcgtccggtcgggtcgggaccgtcggtaccgacggaccgacgggtcctccccggtccccgtccggttcctaccgttcccgttaccgttacccccccg

SEQ ID NO: 279703 - DNA, 727 bp, Homo sapiens
  misc_feature: GYAE6OF02G4XQS.48.43.D10.1.454.CMB.1.raw
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
tcagagtatacatacacgaccggtgctcgatttagactagcagtaagggggcgaggagtcagaccactcaggacacagcatggacatgagggtccccgctcagctcctggggcttctgctgctctggctcccaggtcgccagatggtgacgtccagttgacccagtctccatcctccctgtctgcatctggtggagacagacgtcacctcacgttcgccgggnaagtcgaggcctatttccaatttcttagcctggtatcgancaagaacgagacaacctcctactacctctagatctatcgatcgccgtactagttacgagtacggtcggaccctagtccgtaggttcgagcggtacgacggtgagtacgagggactacggtagttacacctacgtaccaccgtactaccgacggaactccggtaccgtgaccgtacgtaaccgtacggtaaagtttacgttttacgtaaccctttaacgtttacgttttaaacccgtacggtttaacctaaaccgtttaaaccgtttttaaacctaaccctttttaaaccctacgttaaccgtttaaccgggttaccccgtttaaccgggtaaccgtaaacccgggtaacccggttaaccggggtaaccggtaaaaacccggtacggttaaaccaaggggtttccgtaacgggttaccgtacggttaaccccgaacgtttacgtttaccggtcgttttaaccccg

SEQ ID NO: 279704 - DNA, 914 bp, Homo sapiens
  misc_feature: GYAE6OF02F1C94.48.43.D10.1.454.CMB.1.raw
tcagagtatacatacacgaccggtgctcgatttagactagcagtaagggggcaggagtcagacccactcaggacacagcatggacatgagggtccccgctcagctcctggggcttctgctgctctggctcccaggtcgccagatgtgacgtccagttcgaccctagtctccactccctccctgtctcgctatcgtggtacgggagacagacgtaccaccctctacgttcgcccgggagtaaacgtccgacggtacctaactttacccgtaagtttcctttaacgcccgttaggttactacgtacggaaccaaacggtaaaaaccccgtacggtaaacctaaaaccttaccccttaaccgaccctttacccgagtaactaccgtaagtcggagttccggaccttacgttaaggtttaacgacggggtaccggtccggggtacccctaagggttccggtaaggtttacccagggggtaccggtacgtaacggggtacgggtactacggggaaacgggtacgttaacgggttaccttacctaacccggttctaacccgtaaccgtaactccgtaacgacgtaccggttacccgtacggacccgtacccggtaccgtaaacgggttaagtttaacccgtttataacccggtttaactttaaccgttaacgtttaaaccgtaaaccctttaaacccggtttaaaccttttaaaaccttaaacccgtttttaaccccgaacgttaaaccgggttacccgttaccccggttaaaccggggtaacccgggtaaaacccggggtacccgtaaaccgggtaaacggggaaaacccgtaaccgggttaaaccggtaacccggttagggacggtttacccgaacggtaacccctaaccggtaccggtttaccttacggtttaaccc

SEQ ID NO: 279705 - DNA, 700 bp, Homo sapiens
  misc_feature: GYAE6OF02FUHW5.48.43.D10.1.454.CMB.1.raw
  modified_base (138)..(138): a, c, t, g, unknown or other
  misc_feature (138)..(138): n is a, c, g, or t
  modified_base (165)..(165): a, c, t, g, unknown or other
  misc_feature (165)..(165): n is a, c, g, or t
  modified_base (335)..(335): a, c, t, g, unknown or other
  misc_feature (335)..(335): n is a, c, g, or t
  modified_base (452)..(452): a, c, t, g, unknown or other
  misc_feature (452)..(452): n is a, c, g, or t
tcagagtatacatacacgaccggtgctcgatttagactagcagtaagggggcaggagtcagacccactcaggacacagcatggacatggagggtccccgctcagctccgtgggcttctgctgctctggctccgaggtnccagatgtcgacgtccagttcgacccngtctccatccctcctgtctgctatcgtggtagggacacgacgacgtccctaccctctaccgttcggcccgggtacacgtcgacgggtcctacgttacctatttcgttacgccgtagtactcagacaagaaccgaggaaccaactcctaccacctacctagtactctatgntcggtcgtacgtagttacgacggtacggtccggggacctaggtacggtacggttcgacggtcgcggtaggtggactacggagggtacaggtcgtactactactacactacacgtacncgtacgccgtagccgtacgtaccgtacggttagttacgttcgtaaccgttacttacgtttactacgttacgttaaccttacgtttaacctaaccgttacctacgtaacgttaccgtccggttaacggacccgtaacgggtacccgtaggtaacccggtaaaccgtaacgggttacccggaacggttacccggacggtttaccggtaaccttaacccgtacccggttaccgtttccgttaccgttcccg

SEQ ID NO: 279706 - DNA, 806 bp, Homo sapiens
  misc_feature: GYAE6OF02GDW8T.48.43.D10.1.454.CMB.1.raw
tcagagtatacatacacgaccggtgctcgatttagactagcagtaagggggcgaggagtcagacccactcaggacacagcatggacatgagggtccccgctcagctccgtgggcttctgctgctctggactcccaggtcgccagatgtagacgtccagttcgacccagtctccatccctcctgtctagcatcgtggtggacacagacgtcccacctcacgttcggacccgggacacggtcaccggtacctagtttaccctaagtttccgtttacgccgttaggttactaccgtacgaccgtaaacggaaacccgtaacggaaacccttaaaccgttacccgtaacccttacccgttaccgttaacggactttaccgtacgttacgtaacgtcggtaccggttaaccgttaaggtttaaacggacggttaaccggggttaccggaccccgttaggttacccggttaggttaccggaacggtccggaacgtaggtacggtacgttacggaacggtaagtacggtaccgtttcaaccgtactaaccgtaacgtacgttaccgaacgtcctacggtaccgtcggaaccgtaggtacccttaggtaaccgtttacgtttaacgttaacgttaaccgttttaactacggtacgtaaaccctaaacgttttaacccgttaaccttaaccgttaccctaactacgttaaccgtccgtaacggacccgaacggtacgtaacggacgtaaaccggtaccgtacggttaacgtcggtagcccttaggaacccttacgttactccggttccttaaccg

SEQ ID NO: 279707 - DNA, 768 bp, Homo sapiens
  misc_feature: GYAE6OF02IBP70.48.43.D10.1.454.CMB.1.raw
  modified_base (99)..(99): a, c, t, g, unknown or other
  misc_feature (99)..(99): n is a, c, g, or t
  modified_base (139)..(139): a, c, t, g, unknown or other
  misc_feature (139)..(139): n is a, c, g, or t
tcagagtatacatacacgaccggtgctcgatttagactagcagtaagggggcaggagtcagacccactcaggacacagcatggacatgagggtccccgntcagctccgtggggcttctgctgctcgtggctcccaggtnccagatgtgaccgtccagttcgaccccgagtcctcctacttccctcccgtgtctgctattcgtaggtgggacacgagacgtcctaccctacaccgttcggaccggtactaacgtccgaacgtcccttacgtttaccttaattttccggtttacggtaccgttaggttacttacgaacggtaccaaacggtaaaacccgaggtaaacctaaacccttaccgtaacctaaccgtcgtagtacttacttagacgtatacggtaccgttaccgtaagtttacggacgggtacggtccccgggacccttaggtaccggtaggttaccgaagggtccgacgtagggtacggacgttaacgggacggaacgtacgttacgtacctaccgtactacgaacctacgtacgacgaccgacgtaccgtacgaccgtacggtacgtaagagtcgttacgtacgaacttacgttagttacgtacgtacgaacgtacgtaacgttaccgttaaccgttaaccgtttctaaacgttccggttaccggaccgttaaccgggcgttaacgggtacgtacgtaaacgtaaccgaaacggttaccggtggtaccgtaccggtaacctaccgtaccgttgttaacccgg

SEQ ID NO: 279708 - DNA, 906 bp, Homo sapiens
  misc_feature: GYAE6OF02GNDZO.48.43.D10.1.454.CMB.1.raw
  modified_base (100)..(100): a, c, t, g, unknown or other
  misc_feature (100)..(100): n is a, c, g, or t
  modified_base (165)..(165): a, c, t, g, unknown or other
  misc_feature (165)..(165): n is a, c, g, or t
tcagagtatacatacacgaccggtgctcgatttagactagcagtaaggggggcaggagtcagacccactcaggacacagcatggacatgagggtccccgntcagctccgtggggcttctgctgctctggctcccaggtgccagatgtgacgtccagttcgacccngtctccatccctccctgtctgctatcgtggtaggggagaccgaggacgtcctaccccgtctaccgttcggacccggggtactaaacggttccgaacgggtacccttaacttttacccgtaaattttccgttttaacggtccccgttagggttaactccggaaggtacccgaaaaccggtaaaaccgaacggtaaaccctaaaccgttaccctaacgtaccctaccgtagtacttacgtacgtacggtacgtacggtaccgttacggtagttaacgggaggtaccggggtcccggaccgttaggtacccgggttaggtaccggacgggtaccggaggtacggtaacgggtacgtacgggtaacgggaacgtacgttaccggttaaccgtacccttaccgaccgtacgtaaacgccggaactcccgggtaacgtccgttaacggacccgtaacgggtccggtaaaaggtttcgtttaaccgttaccgttaaaccgtttaaccgtttaacttacccggtaaacttaacccgttaaacgtttaaaaccccttaccggttaaacccttaaccgttaacggtttaaaccgggtaacccgggtttaccggaacccgggttaacccggggaaacccggttaccggaaaacggggtttaacccgaaaccggtaccggtaaacggttacgtccgggtaacgtacccgaccggttaaacctaaccgggtttccttacggttcccttaaccgg

SEQ ID NO: 279709 - DNA, 803 bp, Homo sapiens
  misc_feature: GYAE6OF02F5RZQ.48.43.D10.1.454.CMB.1.raw
  modified_base (180)..(180): a, c, t, g, unknown or other
  misc_feature (180)..(180): n is a, c, g, or t
  modified_base (641)..(641): a, c, t, g, unknown or other
  misc_feature (641)..(641): n is a, c, g, or t
tcagagtatacatacacgaccggtgctcgatttagactagcagtaaggggcagttggtagatgcccctctgggagagatccccgagggtgacagccatggacccgtggaagggcctgggctagggacagggaccagacgccgagtccagggagaggacagagaccaagtggactggggtntacgtagtaacgacgccctagctggcgaggagggaccagggtcaaccgtccgtccgagggcacccgtatcgctcgcgaaacgtcggcctaaggaggtcccgaccccgttaggaaacccgttaggaacggtacccaaaggttaccggaaacggaacccccgaaaaacggaccgtaaacgggaccccgtaaaagggttcggggttacggtacggaacccggtaccccgtaggacgggtacgtcggtaccggggtcccctagggtcccctaagggccgtacgccggtccgtaccgtcccccggtagtcccgcggtccgtaacggccggtcgggtccggtaaggtcccgacggttcgggtcccgtacccgcggtttacggcccgttagccggttaccgaccgccgtaacggttcgttccggaccgaaccgtaccggaaacgggccggtacccgtaccgacccggngaacccgcgttacggtacgacgtaacgctacgcgtaaccgtcgacctacgcggaaccgtcgtaccgtggggccggtacggtaacgcccggtaactacccgggaacgccggtcccgggtcccgtcccggtaaccgtccccgttacggtcccccgttaaccccg

SEQ ID NO: 279710 - DNA, 735 bp, Homo sapiens
  misc_feature: GYAE6OF02FZX1Q.48.43.D10.1.454.CMB.1.raw
  modified_base (100)..(100): a, c, t, g, unknown or other
  misc_feature (100)..(100): n is a, c, g, or t
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (632)..(632): a, c, t, g, unknown or other
  misc_feature (632)..(632): n is a, c, g, or t
  modified_base (729)..(729): a, c, t, g, unknown or other
  misc_feature (729)..(729): n is a, c, g, or t
tcagagtatacatacacgaccggtgctcgatttagactagcagtaagggggcaggagtcagacccactccaggacacagcatggacatgagggtccccgntcagctcgtgggcttctgctgctctggcctccgaggtcgccaggatggtgaccgtccaggttcgaccctgtctccatcctccctgtctgcatctggtgganacngacgtccaccctntccttcgggccggtacaacgtcgaggccttagtttacccaagtttccgttacggccttaggtactcgaacgtcaacgtaaaccgacggtaacctaaaccgtccctaactaccgttccgtaagtacttacgtaacgtcgtacgtcgtacggttcctaaggttttaacggacggtacgggtcccgggtaccctaaggtcggtaacggttacgacggtcgtaccgtaaggtggtactacggaacgggtaacgtgtaacgtcctaacgtctacctaccgacgtaccgtagaccgtactccggtacaccgtcggtacccgtaagtaaggttacgtttaacggtacctttaaacgttagttacctaacgttaacgtaaccttaaactttaaaccgttacttaccgtactaacggttaaccncccggtttaacggaaccgtacggtacccgaggtaaaccgaacggtacgtaaccggtaacgtcggtacgtcgtaccggtacctacgtacgtaccgttnttaccg

SEQ ID NO: 279711 - DNA, 277 bp, Homo sapiens
  misc_feature: GYAE6OF01D2A55.29.64.F09.1.454.CMB.1.raw
  modified_base (277)..(277): a, c, t, g, unknown or other
  misc_feature (277)..(277): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagn

SEQ ID NO: 279712 - DNA, 281 bp, Homo sapiens
  misc_feature: GYAE6OF01D5UEC.29.64.F09.1.454.CMB.1.raw
  modified_base (277)..(281): a, c, t, g, unknown or other
  misc_feature (277)..(281): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnnn

SEQ ID NO: 279713 - DNA, 277 bp, Homo sapiens
  misc_feature: GYAE6OF01D22N1.29.64.F09.1.454.CMB.1.raw
  modified_base (275)..(277): a, c, t, g, unknown or other
  misc_feature (275)..(277): n is a, c, g, or t
tcagatagagtactcacgaccggtgctcgatttagcgcgtatacaagggtcagaggccaaaggatgggaggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcggctggcaaggcgcatagnnn

SEQ ID NO: 279714 - DNA, 278 bp, Homo sapiens
  misc_feature: GYAE6OF01AVK0D.29.64.F09.1.454.CMB.1.raw
  modified_base (276)..(278): a, c, t, g, unknown or other
  misc_feature (276)..(278): n is a, c, g, or t
tcagatagagtactcacgaccggtgctcgatttagcgcgtatacaagggtcagaggccaaaggatgggaggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnn

SEQ ID NO: 279715 - DNA, 282 bp, Homo sapiens
  misc_feature: GYAE6OF01BGHVX.29.64.F09.1.454.CMB.1.raw
  modified_base (277)..(282): a, c, t, g, unknown or other
  misc_feature (277)..(282): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnnnn

SEQ ID NO: 279716 - DNA, 282 bp, Homo sapiens; identical to SEQ ID NO: 279715
  misc_feature: GYAE6OF01CKVHQ.29.64.F09.1.454.CMB.1.raw
  modified_base (277)..(282): a, c, t, g, unknown or other
  misc_feature (277)..(282): n is a, c, g, or t

SEQ ID NO: 279717 - DNA, 389 bp, Homo sapiens
  misc_feature: GYAE6OF01CWBY5.29.64.F09.1.454.CMB.1.raw
  modified_base (202)..(203): a, c, t, g, unknown or other
  misc_feature (202)..(203): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (378)..(378): a, c, t, g, unknown or other
  misc_feature (378)..(378): n is a, c, g, or t
  modified_base (380)..(389): a, c, t, g, unknown or other
  misc_feature (380)..(389): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaataatagtggctggtatgtgtcttggggccagggatcgctggtcaccgtctcccnnctcctaccaacgaccgcctacgtccgttccctcccgcgccctaccctccacgagcnccacctcgggcgggacacgacggccgtccggnggtctcgcgttaggacgaacgtaccttacctacgacgttactacgtactcggtaggcgggccggtgacggacggaacggcagtaagngnnnnnnnnnn

SEQ ID NO: 279718 - DNA, 282 bp, Homo sapiens; identical to SEQ ID NO: 279715
  misc_feature: GYAE6OF01C6ML9.29.64.F09.1.454.CMB.1.raw
  modified_base (277)..(282): a, c, t, g, unknown or other
  misc_feature (277)..(282): n is a, c, g, or t

SEQ ID NO: 279719 - DNA, 283 bp, Homo sapiens
  misc_feature: GYAE6OF01DM2OT.29.64.F09.1.454.CMB.1.raw
  modified_base (277)..(283): a, c, t, g, unknown or other
  misc_feature (277)..(283): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnnnnn

SEQ ID NO: 279720 - DNA, 279 bp, Homo sapiens
  misc_feature: GYAE6OF01DLJUV.29.64.F09.1.454.CMB.1.raw
  modified_base (277)..(279): a, c, t, g, unknown or other
  misc_feature (277)..(279): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnn

SEQ ID NO: 279721 - DNA, 344 bp, Homo sapiens
  misc_feature: GYAE6OF01EF1N5.29.64.F09.1.454.CMB.1.raw
  modified_base (339)..(344): a, c, t, g, unknown or other
  misc_feature (339)..(344): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaataatagtggctggtatgtgtcttggggccagggatcgctggtcacagtctcctcagcttccaccaagggcccatcggtcttccccctggcgccctgctccaggagcacctccgagagcacagccgccctgggctgcctggtcaaggactacttccagtactctatctgagcgggctggcaaggcgcatagnnnnnn

SEQ ID NO: 279722 - DNA, 345 bp, Homo sapiens
  misc_feature: GYAE6OF01DQ2S2.29.64.F09.1.454.CMB.1.raw
  modified_base (341)..(345): a, c, t, g, unknown or other
  misc_feature (341)..(345): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaataatagtggctggtatgtgtcttggggccagggatcgctggtcaccgtctcctcagcttccaccaagggcccatcggtcttccccctggccgccctgctccaggagccacctccgagagcacagccgccctgggctgcctggtcaaggctacttccagtactctatctgagcgggctgggcaaggcgcatagnnnnn

SEQ ID NO: 279723 - DNA, 277 bp, Homo sapiens
  misc_feature: GYAE6OF01C7RI3.29.64.F09.1.454.CMB.1.raw
  modified_base (273)..(277): a, c, t, g, unknown or other
  misc_feature (273)..(277): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgactgtggctgcaccatctgtcttcatcttcccgcatctgagtactctatctgagcggctggcaaggcgcatagnnnnn

SEQ ID NO: 279724 - DNA, 280 bp, Homo sapiens
  misc_feature: GYAE6OF01DUSRS.29.64.F09.1.454.CMB.1.raw
  modified_base (277)..(280): a, c, t, g, unknown or other
  misc_feature (277)..(280): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnn

SEQ ID NO: 279725 - DNA, 358 bp, Homo sapiens
  misc_feature: GYAE6OF01D4VTG.29.64.F09.1.454.CMB.1.raw
  modified_base (254)..(254): a, c, t, g, unknown or other
  misc_feature (254)..(254): n is a, c, g, or t
  modified_base (354)..(358): a, c, t, g, unknown or other
  misc_feature (354)..(358): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaataatagtggctggtatgtgtcttggggccagggatcgctggtcaccgtctcctcagcttccaccgaagggcccatcggtcttccccctggcgccctgctccaggancacctccgagagcacgagccgcccgtgggctcgccgtagggtaaaggacctaccttccagtacctctatcgtgaggcgggctggacgaaggcgacatagnnnnn

SEQ ID NO: 279726 - DNA, 285 bp, Homo sapiens
  misc_feature: GYAE6OF01B7N0Y.29.64.F09.1.454.CMB.1.raw
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (277)..(285): a, c, t, g, unknown or other
  misc_feature (277)..(285): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatccttcccgccatctgaatactctatctgagcggntggacaaggcncatagnnnnnnnnn

SEQ ID NO: 279727 - DNA, 296 bp, Homo sapiens
  misc_feature: GYAE6OF01AM8YV.29.64.F09.1.454.CMB.1.raw
  modified_base (277)..(296): a, c, t, g, unknown or other
  misc_feature (277)..(296): n is a, c, g, or t
tcagatagagtactcacgaccggtgctcgatttagcgcgtatacaagggtcaggaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatctcccgccatctgaagtactctatctgagcgggctggcaaggcgcatagnnnnnnnnnnnnnnnnnnnn

SEQ ID NO: 279728 - DNA, 279 bp, Homo sapiens
  misc_feature: GYAE6OF01D4LN3.29.64.F09.1.454.CMB.1.raw
  modified_base (275)..(279): a, c, t, g, unknown or other
  misc_feature (275)..(279): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgactgtggctgcaccatctgtcttcatcttccccgccatctgaatctctatctgagcgggctggcaaggcgcatagnnnnn

SEQ ID NO: 279729 - DNA, 285 bp, Homo sapiens
  misc_feature: GYAE6OF01BY9ZL.29.64.F09.1.454.CMB.1.raw
  modified_base (271)..(271): a, c, t, g, unknown or other
  misc_feature (271)..(271): n is a, c, g, or t
  modified_base (277)..(285): a, c, t, g, unknown or other
  misc_feature (277)..(285): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatccttcccgccatctgaagtactctatctgagcgggctggcaggcncatagnnnnnnnnn

SEQ ID NO: 279730 - DNA, 282 bp, Homo sapiens
  misc_feature: GYAE6OF01CVQP3.29.64.F09.1.454.CMB.1.raw
  modified_base (275)..(282): a, c, t, g, unknown or other
  misc_feature (275)..(282): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatccttcccgcatctgaagtctctatctgagcggctggcaaggcgcatagnnnnnnnn

SEQ ID NO: 279731 - DNA, 440 bp, Homo sapiens
  misc_feature: GYAE6OF01A39G4.29.64.F09.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (386)..(386): a, c, t, g, unknown or other
  misc_feature (386)..(386): n is a, c, g, or t
  modified_base (388)..(389): a, c, t, g, unknown or other
  misc_feature (388)..(389): n is a, c, g, or t
  modified_base (391)..(393): a, c, t, g, unknown or other
  misc_feature (391)..(393): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(440): a, c, t, g, unknown or other
  misc_feature (402)..(440): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaataatagtggctggtatgtgtcttggggccagggatcgctggtcaccgtctcctcagcttccaccaagggcccatcggtccttccccctggccgccctgctccaggancacctcgagacncacagcccgcccgtgggcctcgccgtggtacgaaacgggtaccttaccgttcccgaaggttaccttcttaactccgtggaacgggccggggtctgggaccgaaacgggccgacagtagncnncnnncangntngnnnnnnnnnnnnnnnnnnnnnnnnnnnnnnnnnnnnnnn

SEQ ID NO: 279732 - DNA, 284 bp, Homo sapiens
  misc_feature: GYAE6OF01CDWVY.29.64.F09.1.454.CMB.1.raw
  modified_base (277)..(284): a, c, t, g, unknown or other
  misc_feature (277)..(284): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatacaaacgaactgtggctgcacatctgtcttcatccttcccgccatctgaacgtctctatctgagcggctggcaaggcgacatgnnnnnnnn

SEQ ID NO: 279733 - DNA, 298 bp, Homo sapiens
  misc_feature: GYAE6OF01DO1PT.29.64.F09.1.454.CMB.1.raw
  modified_base (277)..(298): a, c, t, g, unknown or other
  misc_feature (277)..(298): n is a, c, g, or t
tcagatagagtactcacgaccggtgctcgatttagcgcgtatacaagggtcagaggccaaaggatggggagggggtcaggcactgacttcacactgaacatcagtagggtggaggctgaggatattgggatttattactgcatgcagggtacacactggccgttcacttttggccaaggggaccaagctggagatcaaacgaactgtggctgcaccatctgtctcatctccgcatctagaagtactctatctgagcggctggacaaggcgacatagnnnnnnnnnnnnnnnnnnnnnn

SEQ ID NO: 279734 - DNA, 310 bp, Homo sapiens
  misc_feature: GYAE6OF01DZ17U.29.64.F09.1.454.CMB.1.raw
  modified_base (292)..(295): a, c, t, g, unknown or other
  misc_feature (292)..(295): n is a, c, g, or t
  modified_base (297)..(310): a, c, t, g, unknown or other
  misc_feature (297)..(310): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttctacttttggccaggggaccaagctggagatacaaacgactgtggctgccaccatctgtcttcattccttcccgcctatctagaacgtctctatcgtgaggcgggctcggcgaacggcgaccgataggnnnnannnnnnnnnnnnnn

SEQ ID NO: 279735 - DNA, 298 bp, Homo sapiens
  misc_feature: GYAE6OF01AQTHI.29.64.F09.1.454.CMB.1.raw
  modified_base (285)..(298): a, c, t, g, unknown or other
  misc_feature (285)..(298): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatacaaacgaactgtggctgcaccatctgtctcattccttcccgcctatctagaacgtctctatctgacggcggtctggacaaggcgacatagnnnnnnnnnnnnnn

SEQ ID NO: 279736 - DNA, 354 bp, Homo sapiens
  misc_feature: GYAE6OF01BT59U.29.64.F09.1.454.CMB.1.raw
  modified_base (346)..(354): a, c, t, g, unknown or other
  misc_feature (346)..(354): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaataatagtggctggtatgtgtcttggggccagggatcgctggtcaccgtctcctcacgcctccaccaagggccccatcggtccttcccccctggccaccctcctccaagacgccacctctggggggcacagcagccctgggctgcctggtcaaggctacttccagtactctatctgagcgggctggcaaggcgcatagnnnnnnnnn

SEQ ID NO: 279737 - DNA, 295 bp, Homo sapiens
  misc_feature: GYAE6OF01AF8CK.29.64.F09.1.454.CMB.1.raw
  modified_base (225)..(226): a, c, t, g, unknown or other
  misc_feature (225)..(226): n is a, c, g, or t
  modified_base (273)..(274): a, c, t, g, unknown or other
  misc_feature (273)..(274): n is a, c, g, or t
  modified_base (276)..(295): a, c, t, g, unknown or other
  misc_feature (276)..(295): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatacaaacgaactgtggctgcaccatctgtcttnntctcccgcatctgatctctatctgagcgggctggcaaggcgcatagnngnnnnnnnnnnnnnnnnnnnn

SEQ ID NO: 279738 - DNA, 359 bp, Homo sapiens
  misc_feature: GYAE6OF01AUGE8.29.64.F09.1.454.CMB.1.raw
  modified_base (232)..(232): a, c, t, g, unknown or other
  misc_feature (232)..(232): n is a, c, g, or t
  modified_base (290)..(359): a, c, t, g, unknown or other
  misc_feature (290)..(359): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcacatctgtctcatctcccgcntctgaagtactctagtctgacggcgggcgtggacgaacgggccgactaagtagcatcnnnnnnnnnnnnnnnnnnnnnnnnnnnnnnnnnnnnnnnnnnnnnnnnnnnnnnnnnnnnnnnnnnnnnn

SEQ ID NO: 279739 - DNA, 367 bp, Homo sapiens
  misc_feature: GYAE6OF01D2EYZ.29.64.F09.1.454.CMB.1.raw
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (279)..(280): a, c, t, g, unknown or other
  misc_feature (279)..(280): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (303)..(367): a, c, t, g, unknown or other
  misc_feature (303)..(367): n is a, c, g, or t
tcagatagagtactcacgaccggtgctcgatttagcgcgtatacaagggtcagaggccaaaggatgggaggggggtcaggcactgacttcacactgaacatcagtagggtggaggctgaggatattgggatttattactgcatgcagggtacacactggccgttcacttttggccagggggaccaagctggagatcaaacgactgtggctgcaccatctgtcttnatccttcccnccatctgaagtactctatctgagcgggntggcaaggcncatagnnacncgntcagctgatgcanctgnnnnnnnnnnnnnnnnnnnnnnnnnnnnnnnnnnnnnnnnnnnnnnnnnnnnnnnnnnnnnnnnn

SEQ ID NO: 279740 - DNA, 297 bp, Homo sapiens
  misc_feature: GYAE6OF01B79FW.29.64.F09.1.454.CMB.1.raw
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (276)..(297): a, c, t, g, unknown or other
  misc_feature (276)..(297): n is a, c, g, or t
tcagatagagtactcacgaccggtgctcgatttagcgcgtatacaagggtcagaggccaaaggatggggagggggtcaggcactgacttcacactgaacatcagtagggtggaggctgaggatattgggatttattactgcatgcagggtacacactggccgttcacttttggccaggggaccaagctggagatcaaacgaactgnggctgcaccatctgtcttcatcttccgcatcngaatactctatcctgancggggctggcaaggcgcatgnnnnnnnnnnnnnnnnnnnnnn

SEQ ID NO: 279741 - DNA, 324 bp, Homo sapiens
  misc_feature: GYAE6OF01C5Q07.29.64.F09.1.454.CMB.1.raw
  modified_base (300)..(324): a, c, t, g, unknown or other
  misc_feature (300)..(324): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcgagggtacacactgggtccgttctacttttggccgaggggaccaagctggagatacaaacgaactgtggctgcacctatctgtcttcacttccttcccgctatctagaagttcctctatcgtggacggcgggctcggacgaaggcgactaagtagnnnnnnnnnnnnnnnnnnnnnnnnn

SEQ ID NO: 279742 - DNA, 434 bp, Homo sapiens
  misc_feature: GYAE6OF01DQ88J.29.64.F09.1.454.CMB.1.raw
  modified_base (90)..(90): a, c, t, g, unknown or other
  misc_feature (90)..(90): n is a, c, g, or t
  modified_base (134)..(134): a, c, t, g, unknown or other
  misc_feature (134)..(134): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (382)..(434): a, c, t, g, unknown or other
  misc_feature (382)..(434): n is a, c, g, or t
tcagatagagtactcacgaccggtgctcgatttagcgcgtatacaagggtcagaggccaaaggatggggagggggtcaggcactgacttnacactgaacatcagtagggtggaggctgaggatattgggatttnttactgcatgcgagggtacacgtactggtccgttctacttttggccgaggggacctaagctagggagatacgaaacgtaactggtacggctagccacctattccgttacgttccttcgaacttcccgttccccgtactacgttcctaggtaaacgttacctcgttaattccgaggtaccgggtcgggtacgtcgggaccgaagggccgtacgtaagtaaggcaggtgcatgngaactcatcgncgtannnnnnnnnnnnnnnnnnnnnnnnnnnnnnnnnnnnnnnnnnnnnnnnnnnnn

SEQ ID NO: 279743 - DNA, 278 bp, Homo sapiens; identical to SEQ ID NO: 279714
  misc_feature: GYAE6OF02F8YPI.29.64.F09.1.454.CMB.1.raw
  modified_base (276)..(278): a, c, t, g, unknown or other
  misc_feature (276)..(278): n is a, c, g, or t

SEQ ID NO: 279744 - DNA, 281 bp, Homo sapiens
  misc_feature: GYAE6OF02G9RW9.29.64.F09.1.454.CMB.1.raw
  modified_base (276)..(281): a, c, t, g, unknown or other
  misc_feature (276)..(281): n is a, c, g, or t
tcagatagagtactcacgaccggtgctcgatttagcgcgtatacaagggtcagaggccaaaggatgggaggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnnnn

SEQ ID NO: 279745 - DNA, 280 bp, Homo sapiens
  misc_feature: GYAE6OF02GI38S.29.64.F09.1.454.CMB.1.raw
  modified_base (276)..(280): a, c, t, g, unknown or other
  misc_feature (276)..(280): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgactgtggctgcaccatctgtcttcatcttcccgccatctgaagtactctatctgagcgggctggcaaggcgcatagnnnnn

SEQ ID NO: 279746 - DNA, 278 bp, Homo sapiens
  misc_feature: GYAE6OF02JK41X.29.64.F09.1.454.CMB.1.raw
  modified_base (274)..(278): a, c, t, g, unknown or other
  misc_feature (274)..(278): n is a, c, g, or t
tcagatagagtactcacgaccggtgctcgatttagcgcgtatacaagggtcagaggccaaaggatgggaggggtcaggcactgacttcacactgaacatcagtagggtggaggctgaggatattgggatttattactgcatgcagggtacacactggccgttcacttttggccaggggaccaagctggagatcaaacgactgtggctgcaccatctgtcttcatcttcccgccatctgaagtactctatctgagcggctggcaaggcgcatagnnnnn

SEQ ID NO: 279747 - DNA, 285 bp, Homo sapiens
  misc_feature: GYAE6OF02IIJT8.29.64.F09.1.454.CMB.1.raw
  modified_base (275)..(285): a, c, t, g, unknown or other
  misc_feature (275)..(285): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttccgccatctgaagtctctatctgagcgggctggcaaggcgcatagnnnnnnnnnnn

SEQ ID NO: 279748 - DNA, 315 bp, Homo sapiens
  misc_feature: GYAE6OF02JVK9I.29.64.F09.1.454.CMB.1.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (295)..(296): a, c, t, g, unknown or other
  misc_feature (295)..(296): n is a, c, g, or t
  modified_base (298)..(298): a, c, t, g, unknown or other
  misc_feature (298)..(298): n is a, c, g, or t
  modified_base (300)..(315): a, c, t, g, unknown or other
  misc_feature (300)..(315): n is a, c, g, or t
tcagatagagtactcacgaccggtgctcgatttagcgcgtatacaagggtacagaggccaaacggatagggaagggggtccgagggcgactgacttcacactgaacatcagtagggtggaggcttgaggtatagttggggatttagttactgcatggcagggtacacactggccgttcacttttggccaggggaccaagcgtggagatcaaacgaactgtggctggcacgatctgtctcatcttccgcatctgaagtactctatctgtagtcgggntggacaggccgnatgcngnngngnnnnnnnnnnnnnnnn

SEQ ID NO: 279749 - DNA, 295 bp, Homo sapiens
  misc_feature: GYAE6OF02GZLFG.29.64.F09.1.454.CMB.1.raw
  modified_base (281)..(295): a, c, t, g, unknown or other
  misc_feature (281)..(295): n is a, c, g, or t
tcagatagagtactcacgaccggtgctcgatttagcgcgtatacaagggtcgagaggccaaaggatgggagggggtcaggcactgacttcacactagaacatcagtagggtggaggcctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatacgnnnnnnnnnnnnnnn

SEQ ID NO: 279750 - DNA, 296 bp, Homo sapiens
  misc_feature: GYAE6OF02IPKM6.29.64.F09.1.454.CMB.1.raw
  modified_base (281)..(296): a, c, t, g, unknown or other
  misc_feature (281)..(296): n is a, c, g, or t
tcagatagagtactcacgaccggtgctcgatttagcgcgtatacaagggtcagaggtccgaaaggatgggagggggtcaggcactgacttcacactgaacatcagtagggtggaggctgaggatattgggatttattactgcatgcagggtacacactggccgttcactttttaggccaggggaccaagctggagatcaaacgaactgtggctgcaccatctggtcttcatcttcccgccatctgaagtactctatctgagcggctggcaaggcgcatagnnnnnnnnnnnnnnnn

SEQ ID NO: 279751 - DNA, 283 bp, Homo sapiens
  misc_feature: GYAE6OF02G1375.29.64.F09.1.454.CMB.1.raw
  modified_base (276)..(283): a, c, t, g, unknown or other
  misc_feature (276)..(283): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgactgtggctgcaccatctgtcttcatcttcccgccatctgaagtactctatctgagcgggctggcaaggcgcatagnnnnnnnn

SEQ ID NO: 279752 - DNA, 359 bp, Homo sapiens
  misc_feature: GYAE6OF02HXLGH.29.64.F09.1.454.CMB.1.raw
  modified_base (283)..(283): a, c, t, g, unknown or other
  misc_feature (283)..(283): n is a, c, g, or t
  modified_base (285)..(286): a, c, t, g, unknown or other
  misc_feature (285)..(286): n is a, c, g, or t
  modified_base (289)..(293): a, c, t, g, unknown or other
  misc_feature (289)..(293): n is a, c, g, or t
  modified_base (295)..(295): a, c, t, g, unknown or other
  misc_feature (295)..(295): n is a, c, g, or t
  modified_base (298)..(303): a, c, t, g, unknown or other
  misc_feature (298)..(303): n is a, c, g, or t
  modified_base (305)..(305): a, c, t, g, unknown or other
  misc_feature (305)..(305): n is a, c, g, or t
  modified_base (307)..(359): a, c, t, g, unknown or other
  misc_feature (307)..(359): n is a, c, g, or t
tcagatagagtactcacgaccggtgctcgatttagcgcgtatacaagggtcagaggccaaaaggatgggagggggtcaggcactgacttcactacctgaacatcagtagggtggaggctgaggatatgggatttattactgcatgcagggtacactactggccgttcactttttggccaggggaccaagctggagatcaaacgaactgtggctgcacgatctgtcttcatcttcccgccatctgaagtactctatctgagcgggctggtcaaggcgcatagtnannctnnnnntnagnnnnnngncnnnnnnnnnnnnnnnnnnnnnnnnnnnnnnnnnnnnnnnnnnnnnnnnnnnnn

SEQ ID NO: 279753 - DNA, 284 bp, Homo sapiens
  misc_feature: GYAE6OF02H4UOS.29.64.F09.1.454.CMB.1.raw
  modified_base (276)..(284): a, c, t, g, unknown or other
  misc_feature (276)..(284): n is a, c, g, or t
tcagatagagtactcacgaccggtgctcgatttagcgcgtatacaagggtcagaggccaaaggatgggaggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnnnnnnn

SEQ ID NO: 279754 - DNA, 296 bp, Homo sapiens
  misc_feature: GYAE6OF02HAS18.29.64.F09.1.454.CMB.1.raw
  modified_base (275)..(275): a, c, t, g, unknown or other
  misc_feature (275)..(275): n is a, c, g, or t
  modified_base (281)..(296): a, c, t, g, unknown or other
  misc_feature (281)..(296): n is a, c, g, or t
tcagatagagtactcacgaccggtgctcgatttagcgcgtatacaagggtcgagaggccaaaggatgggacggggtcaggcactgacttcgacactgaacactcgagtagggtcggaggctgaggatacttggatttattactgcatgcagggtacacactggccgttcacttttggccaggggaccaagctggagatcaaacgaactgtggctgcaccatctgtcttcatcttcccgccatctgaagtactctatctgagcggctggcaaggcncatagnnnnnnnnnnnnnnnn

SEQ ID NO: 279755 - DNA, 277 bp, Homo sapiens
  misc_feature: GYAE6OF02FVZZU.29.64.F09.1.454.CMB.1.raw
  modified_base (274)..(277): a, c, t, g, unknown or other
  misc_feature (274)..(277): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtctcatcttcccgcatctgaagtactctatctgagcggctggcaaggcgcatagnnnn

SEQ ID NO: 279756 - DNA, 285 bp, Homo sapiens
  misc_feature: GYAE6OF02HE7JR.29.64.F09.1.454.CMB.1.raw
  modified_base (277)..(285): a, c, t, g, unknown or other
  misc_feature (277)..(285): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgccatctgaagtactctatctgagcgggctggcaaggcgcatagnnnnnnnnn

SEQ ID NO: 279757 - DNA, 358 bp, Homo sapiens
  misc_feature: GYAE6OF02GDV1T.29.64.F09.1.454.CMB.1.raw
  modified_base (344)..(358): a, c, t, g, unknown or other
  misc_feature (344)..(358): n is a, c, g, or t
tcagatagagtactcacgaccggtgctcgatttagcgcgtatacaagggcagactcacgattaccgcggacgaatctacgaacactgccttcatggagctcagagccctaacatctgaggacacggccatgtattattgtgcaaagaaataatagtggctggtatgtgtcttggggccagggatcgctggtcaccgtctcctcagcttccaccaagggcccatcggtcttccccctggccgccctgcctccaggacgcacctccgagagcacagccgccctgggctgcctggtcaaggctacttccagtactctatctgagcgggctcggcaaggccgcatagnnnnnnnnnnnnnnn

SEQ ID NO: 279758 - DNA, 278 bp, Homo sapiens
  misc_feature: GYAE6OF02IR91Z.29.64.F09.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (274)..(278): a, c, t, g, unknown or other
  misc_feature (274)..(278): n is a, c, g, or t
tcagatagagtactcacgaccggtgctcgatttagcgcgtatacaagggtcagaggccaaaggatgggaggggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtctcatctcccgcatcngaacgtntctatctgagcggctggcaaggcgcatagnnnnn

SEQ ID NO: 279759 - DNA, 294 bp, Homo sapiens
  misc_feature: GYAE6OF02FQMRV.29.64.F09.1.454.CMB.1.raw
  modified_base (276)..(294): a, c, t, g, unknown or other
  misc_feature (276)..(294): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctgcaccatctgtctcatcttcccgccatctgaagtactctatctgagcgggctggcaaggcgcatagnnnnnnnnnnnnnnnnnnn

SEQ ID NO: 279760 - DNA, 296 bp, Homo sapiens
  misc_feature: GYAE6OF02I7CZH.29.64.F09.1.454.CMB.1.raw
  modified_base (235)..(235): a, c, t, g, unknown or other
  misc_feature (235)..(235): n is a, c, g, or t
  modified_base (281)..(296): a, c, t, g, unknown or other
  misc_feature (281)..(296): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttcacttttggccaggggaccaagctggagatcaaacgaactgtggctcgcaccatctgtcttcatccttcccnccatcctgaagtactctatctgagcggctggcaaggcgtacagtgnnnnnnnnnnnnnnnn

SEQ ID NO: 279761 - DNA, 319 bp, Homo sapiens
  misc_feature: GYAE6OF02I71ZG.29.64.F09.1.454.CMB.1.raw
  modified_base (299)..(299): a, c, t, g, unknown or other
  misc_feature (299)..(299): n is a, c, g, or t
  modified_base (301)..(319): a, c, t, g, unknown or other
  misc_feature (301)..(319): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggattttattactgcatgcagggtacacactggccgttcacttttggcctaggggaccaagctggagatcaaacgactgtggctgcaccatctgtcttcattccttcccgcctatctacgaagtaccttctactcttcggagccgggcttggcaaggtccgctaagtagcagnannnnnnnnnnnnnnnnnnn

SEQ ID NO: 279762 - DNA, 416 bp, Homo sapiens
  misc_feature: GYAE6OF02H0X9K.29.64.F09.1.454.CMB.1.raw
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (394)..(416): a, c, t, g, unknown or other
  misc_feature (394)..(416): n is a, c, g, or t
tcagatagagtactcacgaccggtgctcgatttagcgcgtatacaagggcagactcacgattaccgcggacgaatctacgaacactgccttcatggagctcagagccctaacatctgagacacggccatgtattattgtgacaaaagaataataggtggctggtatgtgtcgttggggccagggatcgctggtaccaccgttctccgtacagccttacccaaccgaacgggcccctagttccggttcccttcccccggtggcccgtcccctggacctccgaggacgtccacccggtcgaagacgccaacgaccgcccgcccgtgggcctcggaccgtggaccgaagtacctactacatctcagtcgnggacgcgggtcncggcacggcactagnnnnnnnnnnnnnnnnnnnnnnn

SEQ ID NO: 279763 - DNA, 311 bp, Homo sapiens
  misc_feature: GYAE6OF02I7MX3.29.64.F09.1.454.CMB.1.raw
  modified_base (80)..(80): a, c, t, g, unknown or other
  misc_feature (80)..(80): n is a, c, g, or t
  modified_base (223)..(223): a, c, t, g, unknown or other
  misc_feature (223)..(223): n is a, c, g, or t
  modified_base (281)..(311): a, c, t, g, unknown or other
  misc_feature (281)..(311): n is a, c, g, or t
tcagatagagtactcacgaccggtgctcgatttagcgcgtatacaagggtcagaggccaaaggatgggagggggtcaggnactgacttcacactgaacatcagtagggtggaggctgaggatattgggatttattactgcatgcagggtacacactggccgttcacttttggccaggggaccaagctggagatcaaacgaactgtggctgcaccatctgtctnatctcccgcatctagaagtctctatctgaacggtcggctggactaaggcgcagtacgnnnnnnnnnnnnnnnnnnnnnnnnnnnnnnn

SEQ ID NO: 279764 - DNA, 303 bp, Homo sapiens
  misc_feature: GYAE6OF02HI66Q.29.64.F09.1.454.CMB.1.raw
  modified_base (279)..(279): a, c, t, g, unknown or other
  misc_feature (279)..(279): n is a, c, g, or t
  modified_base (285)..(303): a, c, t, g, unknown or other
  misc_feature (285)..(303): n is a, c, g, or t
tcagatagagtactcacgaccggtgctcgatttagcgcgtatacaagggtcagaggccaaaggatgggagggggtcaggcactgacttcacactgaacatcagtagggtggaggctgaggatattgggatttattactgcatgcagggtacacactggccgttctactttttggccaggggaccaagctggagatcaaacgtactgtgctgcaccatctgtctcacttcctcccgcatctgaactctctatccgtagaggccgggtctggcaaggccanactagnnnnnnnnnnnnnnnnnnn

SEQ ID NO: 279765 - DNA, 154 bp, Homo sapiens
  misc_feature: GYAE6OF01C3YOM.13.30.C08.1.454.CMB.1.raw
  modified_base (153)..(154): a, c, t, g, unknown or other
  misc_feature (153)..(154): n is a, c, g, or t
tcagtcacgtactacacgaccggtgctcgatttagtctgacgtcaaagggaagggaccagggtggaaatcaaacgaactgtggctgcaccatctgtcttcatcttcccgccatctgatagtacgtgactgagcgggctggcaaggcgcatagnn

SEQ ID NO: 279766 - DNA, 153 bp, Homo sapiens
  misc_feature: GYAE6OF01DSXV7.13.30.C08.1.454.CMB.1.raw
  modified_base (153)..(153): a, c, t, g, unknown or other
  misc_feature (153)..(153): n is a, c, g, or t
tcagtcacgtactacacgaccggtgctcgatttagtctgacgtcaaagggaagggaccagggtggaaatcaaacgaactgtggctgcaccatctgtcttcatcttcccgccatctgatagtacgtgactgagcgggctggcaaggcgcatagn

SEQ ID NO: 279767 - DNA, 214 bp, Homo sapiens
  misc_feature: GYAE6OF01EN0FB.13.30.C08.1.454.CMB.1.raw
  modified_base (212)..(214): a, c, t, g, unknown or other
  misc_feature (212)..(214): n is a, c, g, or t
tcagtcacgtactacacgaccggtgctcgatttagtctgacgtcaaagggaaagggaccaccgtcaccgtcgcctcagcctccaccaagggcccatcggtcttcccctggcaccctcctccaagagcacctctgggggcacagcggccctgggctgcctggtcaaggactacttcctagtacgtgactgagcgggctggcaaggcgcatagnnn

SEQ ID NO: 279768 - DNA, 461 bp, Homo sapiens
  misc_feature: GYAE6OF01B9XHA.13.30.C08.1.454.CMB.1.raw
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (444)..(461): a, c, t, g, unknown or other
  misc_feature (444)..(461): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatactctgtgcgagagatcgagatgtgtcatcgcggggcacttttgatatcgtggggccaagggtcgatggtcatcgtctcttcagcctccaccgaagggcccatcggtcttccccnggtccncctgcctccaggancacctcgagcgcacacgcgccctgggctcgccgtggtacgaaggactacttccgtagtacgtgaaccgtggacggtccgggactgggacaaagggccacagtacgcnnnnnnnnnnnnnnnnnn

SEQ ID NO: 279769 - DNA, 425 bp, Homo sapiens
  misc_feature: GYAE6OF01AC2RL.13.30.C08.1.454.CMB.1.raw
  modified_base (418)..(425): a, c, t, g, unknown or other
  misc_feature (418)..(425): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatcgtggggccaagggtcgatggtcatcgtctcttcagcctccaccaaggcccatcggtctcccctggcgccctgctccaggagcacctcgagagcacagccggccctgggctgcctggtcaggactactcctagtacgtgactgagcgggctgggcaaggcgcatagnnnnnnnn

SEQ ID NO: 279770 - DNA, 423 bp, Homo sapiens
  misc_feature: GYAE6OF01A0LAV.13.30.C08.1.454.CMB.1.raw
  modified_base (332)..(332): a, c, t, g, unknown or other
  misc_feature (332)..(332): n is a, c, g, or t
  modified_base (419)..(423): a, c, t, g, unknown or other
  misc_feature (419)..(423): n is a, c, g, or t
tcagtcacgtactacacgaccggtgctcgatttagtctgacgtcaaagggaaaggggctggagtggattggggaaatccatcatagtgggaccacctactacagcccgtccctcaatagtcgcgtcaccatgtcagtggacgagcccaagaaccagttctccctgagcctgacctctgtgaccgccacggactcggccctatacttctgtgcgagagatcgagatgtgtcatcgcggggcacttttgatatctggggccaagggtcgatggtcatcgtctcttcagcctccaccaagggcccatcggtcttcccctgcgccctgctccaggngcacctccgagagcacagcggccctgggctgcctggtcaaggactacttcctagtacgtgactgagcgggctggcaaggcgcatagnnnnn

SEQ ID NO: 279771 - DNA, 428 bp, Homo sapiens
  misc_feature: GYAE6OF01EYFLR.13.30.C08.1.454.CMB.1.raw
  modified_base (423)..(428): a, c, t, g, unknown or other
  misc_feature (423)..(428): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggccgccctgctccaggacgcacctccgagagcacagcggccctgggctgcctggtcaaggctacttcctagtacgtgactgagcgggctgggcaaggcgcatagnnnnnn

SEQ ID NO: 279772 - DNA, 561 bp, Homo sapiens
  misc_feature: GYAE6OF01CNBT1.13.30.C08.1.454.CMB.1.raw
tcagtcacgtactacacgaccggtgctcgatttagtctgacgtcaaaagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgactctgtctcttgggtccagcaacacccagtcacaggccccaaagtcatgctgtgcaatgtcactcttcagtcctcaagacgtccctgtactttttctcttgccttcgaggttcttgcctaggtcccggcctccggaggccatccacgtggacctccgacggctggcgggcgaggcctgccttcgtttgtcgtcttgggcaagggccggccgtctatcgacctatcctcgtggacctccgacgggtcctggccggacggacggcgttaggtacgtttggttgggtcgtcgttgggtacg

SEQ ID NO: 279773 - DNA, 631 bp, Homo sapiens
  misc_feature: GYAE6OF01CSC38.13.30.C08.1.454.CMB.1.raw
tcagtcacgtactacacgaccggtgctcgatttagtctgacgtcaaagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgtattttgggagttttgactctgtctcttgggtccagcaacaccagtcacacggccccaaagtcatgctgtgacaatgtcactctcacgtcctacaagtacgtccctgtactttttctcttcgccttcggtacggttcttcgcgtacggtcccggtcccgtccggacggtcctactccacgtcgacctccgaggctcgggcgggcgaggtcctcgtccttcgtttgtcgtcgttgggacgaacgggtccgaccgttcgtaacgtcgtaaccctacgttccgtacgtcggtaaccgtcccgaacggtccgttacgggaccgggtaacgggacgggtccgttagggttaacggttttcgggttagggttcggtccggttggggtaccg

SEQ ID NO: 279774 - DNA, 568 bp, Homo sapiens
  misc_feature: GYAE6OF01B9P7J.13.30.C08.1.454.CMB.1.raw
tcagtcacgtactacacgaccggtgctcgatttagtctgacgtcaaagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgactctgtctcttgggtccagcaacaccagtcacaggccccaaagtcatgctgtgcaatgtcactcttcagtcctacaagacgtccctgtatttttctctcgcctcgagtcttgcagtccggcctccgaggccatcacgtggactccgaggctggcgggcgaggctcgtccttcgtttgtgtcgttggcgaagggtccggtccttcgtactcgacctactccgtcgtcggacctcccgaggtccgttgggaccgggtacggacggtccgttaggtacgtttcgggttagggtcgtcgttgggtaccgg

SEQ ID NO: 279775 - DNA, 232 bp, Homo sapiens
  misc_feature: GYAE6OF01CM1U6.13.30.C08.1.454.CMB.1.raw
  modified_base (213)..(232): a, c, t, g, unknown or other
  misc_feature (213)..(232): n is a, c, g, or t
tcagtcacgtactacacgaccggtgctcgatttagtctgacgtcaaagggaaagggaccaccgtcaccgtcgcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnnnnnnnnnnnnnnn

SEQ ID NO: 279776 - DNA, 429 bp, Homo sapiens
  misc_feature: GYAE6OF01CHMED.13.30.C08.1.454.CMB.1.raw
  modified_base (421)..(429): a, c, t, g, unknown or other
  misc_feature (421)..(429): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatcgtggggccaagggtcgatggtcatcgtctcttcagcctcaccaagggcccatccggtcttccccctggccgccctgctccagagcacctccgagagcacagcggccctgggctgcctggtcaggactacttcctagtacgtgactgagcgggctggcaaggcgcatagnnnnnnnnn

SEQ ID NO: 279777 - DNA, 217 bp, Homo sapiens
  misc_feature: GYAE6OF01DSHQ3.13.30.C08.1.454.CMB.1.raw
  modified_base (212)..(217): a, c, t, g, unknown or other
  misc_feature (212)..(217): n is a, c, g, or t
tcagtcacgtactacacgaccggtgctcgatttagtctgacgtcaaagggaaagggaccaccgtcaccgtcgcctcagcctccaccaagggcccatcggtcttccccctggcaccctcctccaagagcacctctgggggcacagcggccctgggctgcctggtcaaggactacttctagtacgtgactgagcgggctggcaaggcgcatagnnnnnn

SEQ ID NO: 279778 - DNA, 742 bp, Homo sapiens
  misc_feature: GYAE6OF01DNA0O.13.30.C08.1.454.CMB.1.raw
  modified_base (234)..(234): a, c, t, g, unknown or other
  misc_feature (234)..(234): n is a, c, g, or t
  modified_base (378)..(378): a, c, t, g, unknown or other
  misc_feature (378)..(378): n is a, c, g, or t
tcagtcacgtactacacgaccggtgctcgatttagtctgacgtcaaagggaaaggggcctcggggacccttgggctgatccttggtctcctgctcctcaggctcacctgggcccagtagtgactcactagagtgtgtttctcctcttccaggctcttgggcccagtctgccctgattcagcctcctcccgcgtccgagtctcttggtcagtcagtcaccatctctaagctgganccagcagtgtattttgggagttttgactgtgtcgtcgttgggtccagcaaccaccgagtccacgacggacccccaaaagtcatgctgtcgcaatcgtactactcttcgacgtcctacaagtccgtaccttagttactttttccnccgttacgtaccttcggtaacggttcgttacggtccgtaaccggtcccggtacccgtacccggtaacgggccctaacgttaccgaaccgtttccgggaacccttacccggaagggtcccgttcgggccggggacggtacggtccgtccgtccgtttcgttttcggtcgttcggttacggaccgtaacgggtcccggtaccttacgtaacgttcccgtaaccgtacgttacccgttcgtaccgggtacccgttaccggtacggggtaccgttccggggaacccgggtaccgggtaacggttcccgttaagggttaccggttttcgggtttaccggggtcggttccgggttcgggttaacccgggg

SEQ ID NO: 279779 - DNA, 867 bp, Homo sapiens
  misc_feature: GYAE6OF01DS3L5.13.30.C08.1.454.CMB.1.raw
  modified_base (238)..(238): a, c, t, g, unknown or other
  misc_feature (238)..(238): n is a, c, g, or t
tcagtcacgtactacacgaccggtgctcgatttagtctgacgtcaaagggaaagggcctcggggacccttgggctgatccttggtctcctgctcctcaggctcacctggccagtagtgactcactagagtgtgttctcctcttccaggctcttcgggcccagtctgccctgattcagcctccgtccgcgtccgagtctgttggtcagtcgagtcaccgtatctacgtaagcgtggacncgagtcaggtgtagttttcgggagttttcgacgttcgttgttcgttccggtttcgggtacctaacgggtacccgtaaacctacccgtaacggttacccgtaaccggaacccggttaccccccgtaaaaagttcccgtaacggtttcgttaccgtttaacggacctaaacttccgggttacctaacgtttcctaacgtaccgttactacgtaacgtcgttaccgttagtttactttttcgtaccgtcgttaccgtcggttagtccgtttcgaccgtccgggtccgtacccggtccggaaacggtccctagtaccgtaccggttacggaccttacccgggacggttccggtacggggcggggtaaccgttccgggtccgtttaccggtcccgttttcggtttagtccggtacggtttaccgggaaagtcccggggtaacccgttccgttaacggtttaccggacccttaaacgggttacccgttccgttaacggtaccccgggtttaaacctacccgggttacgggcccggttacgggtaacccgggtaacggttcccgggttaagttcggggtttaacgtttcgggggttacgttaccggttccggttacggttaacgggtaaccccggg

SEQ ID NO: 279780 - DNA, 159 bp, Homo sapiens
  misc_feature: GYAE6OF01DB539.13.30.C08.1.454.CMB.1.raw
  modified_base (155)..(159): a, c, t, g, unknown or other
  misc_feature (155)..(159): n is a, c, g, or t
tcagtcacgtactacacgaccggtgctcgatttagtctgacgtcaaagggaagggaccagggtggaaatcaaacgaactgtggctgcaccatctgtcttcatcttcccgccatctgatagtacgtgactgagcgggtctaggcaaggcgcatagnnnnn

SEQ ID NO: 279781 - DNA, 556 bp, Homo sapiens
  misc_feature: GYAE6OF01BLBRP.13.30.C08.1.454.CMB.1.raw
  modified_base (525)..(556): a, c, t, g, unknown or other
  misc_feature (525)..(556): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcggggctacttttgatagtcgtcggggaccgaagggtcgagtgggtcatccgtctcttcacgcctccaccgaacgggccctatccggtccttcccccgtggcccgtccctcgcctccgaggacgaccacccgtccgagacgaccacgacgccggcccgtcgggctcggcccgttagggaccaaacgggtacctttaccgttacccgtaacggttacggtacggaccgttagggacgggccgggggtacttcggggacccgtaaacggggccgtacgaacgtaggctagcnnnnnnnnnnnnnnnnnnnnnnnnnnnnnnnn

SEQ ID NO: 279782 - DNA, 565 bp, Homo sapiens
  misc_feature: GYAE6OF01EKINF.13.30.C08.1.454.CMB.1.raw
  modified_base (221)..(221): a, c, t, g, unknown or other
  misc_feature (221)..(221): n is a, c, g, or t
  modified_base (529)..(529): a, c, t, g, unknown or other
  misc_feature (529)..(529): n is a, c, g, or t
  modified_base (531)..(543): a, c, t, g, unknown or other
  misc_feature (531)..(543): n is a, c, g, or t
  modified_base (545)..(565): a, c, t, g, unknown or other
  misc_feature (545)..(565): n is a, c, g, or t
tcagtcacgtactacacgaccggtgctcgattttagtctgacgtcaaagggaaaggggctggagtggattggggaaatctatcatagtgggaccacctactacagccccgtccctcaatagtcgcgtcaccatgtcagtggacgagcccaaagaaccagttcctccctgagcctgacctctgtgaccgccgcggactcggccctatacttctgtgcgaganatcgagagtgtgtcatcggcggggtctacgttttgatatcggtggggaccgaaggggtcgagtcggacctagtcgtcttcttacacgtccctccaaccgaacggtcccctagttcccggttcccttacccccggtggccccgtccccgtaccgcccgtaccgtacgggacacctacccgtaccgagaacgcgaacgacggcccggtccggtcggctcggccgttacggaacgtaaggtacccttacgttaccctaaggtaccgtgtacgtaggcggacgggtcgtggaaccgacgggccagtactagngnnnnnnnnnnnnngnnnnnnnnnnnnnnnnnnnnn

SEQ ID NO: 279783 - DNA, 158 bp, Homo sapiens
  misc_feature: GYAE6OF01AUHVR.13.30.C08.1.454.CMB.1.raw
  modified_base (133)..(133): a, c, t, g, unknown or other
  misc_feature (133)..(133): n is a, c, g, or t
  modified_base (155)..(158): a, c, t, g, unknown or other
  misc_feature (155)..(158): n is a, c, g, or t
tcagtcacgtactacacgaccggtgctcgatttagtctgacgtcaaagggaaagggaccagggtggaaatcaaacgaactgtggctgcaccatctgtcttcatcttcccgccatctgatagtacgtgactgancgggctgggcaaggcgcatagnnnn

SEQ ID NO: 279784 - DNA, 829 bp, Homo sapiens
  misc_feature: GYAE6OF01B6XLJ.13.30.C08.1.454.CMB.1.raw
  modified_base (246)..(246): a, c, t, g, unknown or other
  misc_feature (246)..(246): n is a, c, g, or t
tcagtcacgtactacacgaccggtgctcgatttagtctgacgtcaaagggaaaggggcctcggggacccttgggctgatccttggtctcctgctcctcaggctcacctgggcccagtagtgactcactagagtgtgtttcctccctctttccaggctcttgggcccagtctgccctgattcagccctcctcccgcgtccgagtctcttggtccagtcagtccaccattcctacctaagcgtggacnccagcagtgtagttttgggattttgacttctgtctcgttcgggtaccagtaccaaccgaccgtagtccgaacgaaccggtaccccaaaggtcagttcgtacctggtactactaacgttcgtaccctactttcctacgtacgttacctaacgtaacgtccgttacccttgtttacttttccgtacgtcgtaccgtcgtaggttctacgccgtaccggttcccgaccgttcccgggacgtaccctactacccgtaccggttacggtaccctaccggtaacgggtcccgttacgggacccgggggacttacccggggtcccttccggtttaccccgttttcggtttcggtttaccggttcccgggttaacgggtacccggtaaccggggtcccgtttacccgttaaccggtacggttaacccctaaccggttccgttacccggttaaaccgggtcggttaacccctacccggggttacgggtaacccggttccggggacggggttaaccggtaacggggttcctttaaacgggtttcggttttaacggggtttcccgggacgggtttaccgggtggtaaccccggg

SEQ ID NO: 279785 - DNA, 571 bp, Homo sapiens
  misc_feature: GYAE6OF01ERNUE.13.30.C08.1.454.CMB.1.raw
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
  modified_base (541)..(571): a, c, t, g, unknown or other
  misc_feature (541)..(571): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaaagaaccagttcctcccgtgagcctcgaccttctgtcgaccgccgcggacgtccggccctatacttctggtcgcgagagatcgagtatgtgtcacgtcggcggggtcttacgtttnattacgtcggtcggggaccgtaagggtcgtagtcggtctagtccgttctctacgcncctacccgaacgaaccggccctagtccggttcccttccccgcggccncccgtcgcctaccgacgctccgccgtacgagacgaccaacggtcggccggtccggtacggccgtaccgcggtacgacgtaaaccggtccttaaccgttcgtaagttaccggtcgtaacgtcgggaccggcgggtcggttacggaaaccggaggcccgtaaancgtagcangtcnnnnnnnnnnnnnnnnnnnnnnnnnnnnnnn

SEQ ID NO: 279786 - DNA, 150 bp, Homo sapiens
  misc_feature: GYAE6OF02IZB46.13.30.C08.1.454.CMB.1.raw
tcagtcacgtactacacgaccggtgctcgatttagtctgacgtcaagggaagggaccagggtggaatcaaacgaactgtggctgcaccatctgtcttcatcttcccgccatctgatagtacgtgactgagcgggctggcaaggcgcatag

SEQ ID NO: 279787 - DNA, 152 bp, Homo sapiens
  misc_feature: GYAE6OF02JAYVU.13.30.C08.1.454.CMB.1.raw
  modified_base (152)..(152): a, c, t, g, unknown or other
  misc_feature (152)..(152): n is a, c, g, or t
tcagtcacgtactacacgaccggtgctcgatttagtctgacgtcaaagggaagggaccagggtggaatcaaacgaactgtggctgcaccatctgtcttcatcttcccgccatctgatagtacgtgactgagcgggctggcaaggcgcatagn

SEQ ID NO: 279788 - DNA, 153 bp, Homo sapiens
  misc_feature: GYAE6OF02GOPO4.13.30.C08.1.454.CMB.1.raw
  modified_base (152)..(153): a, c, t, g, unknown or other
  misc_feature (152)..(153): n is a, c, g, or t
tcagtcacgtactacacgaccggtgctcgatttagtctgacgtcaaagggaagggaccagggtggaaatcaaacgaactgtggctgcaccatctgtcttcatcttccgccatctgatagtacgtgactgagcgggctggcaaggcgcatagnn

SEQ ID NO: 279789 - DNA, 426 bp, Homo sapiens
  misc_feature: GYAE6OF02GFH6E.13.30.C08.1.454.CMB.1.raw
  modified_base (421)..(426): a, c, t, g, unknown or other
  misc_feature (421)..(426): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctctgggggcacagcggccctgggctgcctggtcaaggactacttcctagtacgtgactgagcgggctggcaaggcgcatagnnnnnn

SEQ ID NO: 279790 - DNA, 428 bp, Homo sapiens
  misc_feature: GYAE6OF02I7G0B.13.30.C08.1.454.CMB.1.raw
  modified_base (421)..(428): a, c, t, g, unknown or other
  misc_feature (421)..(428): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaaggggtcgatggtcatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnnn

SEQ ID NO: 279791 - DNA, 153 bp, Homo sapiens
  misc_feature: GYAE6OF02FU6L4.13.30.C08.1.454.CMB.1.raw
tcagtcacgtactacacgaccggtgctcgatttagtctgacgtcaaagggaaagggaccagggtggaaatcaaacgaactgtggctgcaccatctgtcttcatcttcccgccatctgatagtacgtgactgagcgggctggcaaggcgcatag

SEQ ID NO: 279792 - DNA, 430 bp, Homo sapiens
  misc_feature: GYAE6OF02GNJCB.13.30.C08.1.454.CMB.1.raw
  modified_base (422)..(430): a, c, t, g, unknown or other
  misc_feature (422)..(430): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatagcggggcacttttgatatctggggccaagggtcgatggtcatcgtctcttcagcctccaccaagggcccatcggtcttccccctggccgccctgctccaggagcacctccgagagcacagcggccctgggctgcctggtcaaggactacttcctagtacgtgactgagcgggctggcaaggcgcatagnnnnnnnnn

SEQ ID NO: 279793 - DNA, 153 bp, Homo sapiens; identical to SEQ ID NO: 279791
  misc_feature: GYAE6OF02FQ1Q1.13.30.C08.1.454.CMB.1.raw

SEQ ID NO: 279794 - DNA, 520 bp, Homo sapiens
  misc_feature: GYAE6OF02GVAGL.13.30.C08.1.454.CMB.1.raw
tcagtcacgtactacacgaccggtgctcgatttagtctgacgtcaaagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgactctgtctcttgggtccagcaacacccagtcacaggccccaaagtcatgctgtgcaatgtcactcttcagtcctcaagagtccctgatttttctctgcctcgaggtcttgcagtccggcctccgaggccatcactggactccaggctgccgggcgaggctgcctctttgtgcttggcaggcgcctcgtatcgaccatctctcggacctccgaggtcctggccggacgcggcgtgagtttggttggtgtcgttggtacg

SEQ ID NO: 279795 - DNA, 607 bp, Homo sapiens
  misc_feature: GYAE6OF02HTVW7.13.30.C08.1.454.CMB.1.raw
tcagtcacgtactacacgaccggtgctcgatttagtctgacgtcaaagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgacttctgtctcttgggtccagcaacacccagtcacaggccccaaagtcatgctgtgcaatgtcactcttcagtcctcaagacgtccctgtactttttctctgtccctcgacggttcttgctacggtcccggcctccggacggccactcacgtcggacctccgacggctcggccggggcggacggcctcggccctttcgtttcgtcggtccgttgggaccgtaacgggtcccggtcctcgttaacgtcgtaaccctagtccttcgtacggtaccgttccgacgggtccgttcggaccgggacggacggtcgtggtacgtttggttcgggttcggtcgttgggtaccg

SEQ ID NO: 279796 - DNA, 505 bp, Homo sapiens
  misc_feature: GYAE6OF02JG11M.13.30.C08.1.454.CMB.1.raw
  modified_base (357)..(357): a, c, t, g, unknown or other
  misc_feature (357)..(357): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagtcacgtactacacgaccggtgctcgatttagtctgacgtcaaagggaaagggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggattttgactctgtctcttgggtccagcaacacccagtcacaggccccaaagtcatgctgtgcaatcgtcactcttcagtcctcaagagtcccctgtatttttcnctgcctcggagtcttgcacgtccgcctccgaggccatcactggactcgagctgcggcgagctgcctnttgtgcttgcacggcgcctnatcgactatctcnggtactcgagctggacgcgagtctgtattcggttggcgtcgtggtacg

SEQ ID NO: 279797 - DNA, 216 bp, Homo sapiens
  misc_feature: GYAE6OF02IB3YL.13.30.C08.1.454.CMB.1.raw
  modified_base (213)..(216): a, c, t, g, unknown or other
  misc_feature (213)..(216): n is a, c, g, or t
tcagtcacgtactacacgaccggtgctcgatttagtctgacgtcaaagggaaagggaccaccgtcaccgtcgcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnn

SEQ ID NO: 279798 - DNA, 235 bp, Homo sapiens
  misc_feature: GYAE6OF02HC292.13.30.C08.1.454.CMB.1.raw
  modified_base (215)..(235): a, c, t, g, unknown or other
  misc_feature (215)..(235): n is a, c, g, or t
tcagtcacgtactacacgaccggtgctcgatttagtctgacgtcaaagggaaagggaccgaccgtcaccgtcgcctcagcctccaccaagggcccatcggtccttccccctggcaccctcctccaagagcacctctgggggcacagcggccctgggctgcctggtcaaggactacttcctagtacgtgactgagcgggctggcaaggcgcatagnnnnnnnnnnnnnnnnnnnnn

SEQ ID NO: 279799 - DNA, 525 bp, Homo sapiens
  misc_feature: GYAE6OF02I7NZC.13.30.C08.1.454.CMB.1.raw
  modified_base (486)..(489): a, c, t, g, unknown or other
  misc_feature (486)..(489): n is a, c, g, or t
  modified_base (492)..(493): a, c, t, g, unknown or other
  misc_feature (492)..(493): n is a, c, g, or t
  modified_base (495)..(495): a, c, t, g, unknown or other
  misc_feature (495)..(495): n is a, c, g, or t
  modified_base (497)..(525): a, c, t, g, unknown or other
  misc_feature (497)..(525): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggcccctatacttctgtgcgagagatcgagatgtgtcagtcgcggggcacgtttttgatatcgtggggccaagggtcgatggtcagtcgtctctcagcctccacgaaggcccagtccggtccttccccctggcccgccctgcctccagggagccacctccggagacgcaccgtacggccgggtccccgtggggcctcggcccgttcggtacaaacgggtacttacccttaccgtacggtttacgtcggacctagggacgcggggtctcgggcaaacgggcgacaataggtcnnnngcnngntnnnnnnnnnnnnnnnnnnnnnnnnnnnnn

SEQ ID NO: 279800 - DNA, 586 bp, Homo sapiens
  misc_feature: GYAE6OF02IFSBI.13.30.C08.1.454.CMB.1.raw
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
  modified_base (490)..(490): a, c, t, g, unknown or other
  misc_feature (490)..(490): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(586): a, c, t, g, unknown or other
  misc_feature (556)..(586): n is a, c, g, or t
tcagtcacgtactacacgaccggtgctcgatttagtctgacgtcaaagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcgccctatacttctgtgcgagagatcgagatgtgtcagtcggcggggctacgttttgattatcgtggggaccaaagggtcgagttggtcattcgtctcttcgagcctccaccgaacgggccctagtccggttcccttccccccgtggcccgtcccctcgtcccgtaccccgtagggaacncccgtaccccgcccggtaagngacccacgacggcccggggccccgttacggggcctcggcccgttacggtccgaaaaccgggtaccttaaccggtttcctaaacgggtcccggttanaaccggttcggaacggtccggggtctccgggacgtaaacgggcgaacgtagtaggcnngngngngnnnnnnnnnnnnnnnnnnnnnnnnnnnnnnn

SEQ ID NO: 279801 - DNA, 732 bp, Homo sapiens
  misc_feature: GYAE6OF02ITZ5V.13.30.C08.1.454.CMB.1.raw
  modified_base (245)..(245): a, c, t, g, unknown or other
  misc_feature (245)..(245): n is a, c, g, or t
  modified_base (656)..(656): a, c, t, g, unknown or other
  misc_feature (656)..(656): n is a, c, g, or t
tcagtcacgtactacacgaccggtgctcgatttagtctgacgtcaaagggaaaggggcctcggggacccttgggctgatccttggtctcctgctcctcaggctcacctgggccagtagtgactcactagagtgtgttctccctcttcaggctcgttcgggcccagtctcgccctgacttcacgcctcctcccgcgtccgagtcctcgttggtcagtcagtccactactcctcctaagcgtggacnccagactaggtagttagtttttcggggtagttttcgtaccgttcgttcgttcgttacgttacggggtaccctagtaaccgaaacctaaccccgtagtacccaaaccggtaccggtaacccccgtaaaaagtccgtaacgttacgtccgttcgtacggtacctaaaggtccgttaccgtaaccgttcttaccgacggttcctaacggaacgtacgttccgttacgttacttttcctcggttacgttaccggtcgtacggttctacggccgtacccggttccggaccctcgggtaaccgccgtactacgtaccgtcgaccgttccggacgtcggtcggaccgggtacgcggtaccgtcgtcgttcgttcgtcgtcgtaccgacggtaccggcgtacctcgtacgtcgtaaccncgttcgtcgtaccggccgtactacggcgtccggacgtcggacgtcgtacgtagttccggtgtcgtcggtgtaccgg

SEQ ID NO: 279802 - DNA, 558 bp, Homo sapiens
  misc_feature: GYAE6OF01CRPCJ.35.46.E02.1.454.CMB.1.raw
  modified_base (203)..(203): a, c, t, g, unknown or other
  misc_feature (203)..(203): n is a, c, g, or t
tcagtacagatcgtcacgaccggtgctcgatttagactcatctacagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtagtctggtaccagcagaaacctggccaggctcccaggctcctcatctatggtgcatcccaccagggcccacgtggtactcccagccaggttccagtggcaggtgggtctgggacagtacttcactctcaccatcagcagcctgcagtctagaagtattatgctagtttatcactgtacagtctaagtttaatagtcgtcggccccgcgtccttcgttcgtttcgggaccgggtacggggtacccgtaaggggttggaacggtaacgtacgaaaaaggtacgttggtacggcttacggccgtaaccgtacg

SEQ ID NO: 279803 - DNA, 697 bp, Homo sapiens
  misc_feature: GYAE6OF01BRKVJ.35.46.E02.1.454.CMB.1.raw
  modified_base (107)..(107): a, c, t, g, unknown or other
  misc_feature (107)..(107): n is a, c, g, or t
tcagtacagatcgtcacgaccggtgctcgatttagactcatctacagggaaagggctttgcctgatttctgttgataccaattttaaaatagggagtttaatgtctntctgctctggctctctacgtgccgacgatgtgacataccacgatagaccgaacgtactccactccttccttcgtctcgtctatctgtggagacgacgagtcgaccactacacttcgtcacgcgtacgtcacggactaacttaactacctaatttaaattagtatactaacagaaatacagacgaagaccctaactacctgtactacacgtaatcgactctacctaaacgtttaggtaaaccgtaaggggtacccgacgttaaccgaggtacctttacgacgtagggtaagttagggaacgtagtcggggtaacgtaaggtactttttaaccgttttctaacctaaaccttcaacgcgtacgccgtacgacgtacgacgtacgaacgtaactagttacgaactaacaacttaacttacttaacgtaactaaactaataataagtactagtacgtaccgtactaacgttacgttaacgttacgtttacggtaccgtacgggtaacgtacgggtaaggtacgtaaacgtacgtaataaccggtacgttacggtacggtacgttacgtctaactacgttcttccggttcttacg

SEQ ID NO: 279804 - DNA, 591 bp, Homo sapiens
  misc_feature: GYAE6OF01A25KQ.35.46.E02.1.454.CMB.1.raw
tcagtacagatcgtcacgaccggtgctcgatttagactcatctacagggaaagggggcaggagtcagtcccaaccaggacacagcatggacatgaggtccctgctcagctcctggggctcctgctgctctggctctcaggtgccagatgtgacatccagatgacccagtctccatccttcctgtctgcatctgtgggagacagagtcaccatcacttgccaggctagtcaggacattaactcctatttaaattggtatcaacagaaatcaggcaaagcccctaaactcctgatctacgatgcatccaatttggaaacagggtccatcgagattcagtggaagtggatcgtgggacagtattttacttcaccatcagctagcccgtcgacgaccgtcgtaaggaacgtaatttagtacgtaaccaattaactttaacttaacgttacgtaaacctaaattaattacgtagtacgttacgtaccgttaccgaccttagttaacgttaccgttttacggtttaccggacgggtaaccggtaaaccggttaagggttacggaacgttaacgtaacttaacggtaacgttaacggg

SEQ ID NO: 279805 - DNA, 617 bp, Homo sapiens
  misc_feature: GYAE6OF01CPZRA.35.46.E02.1.454.CMB.1.raw
  modified_base (521)..(521): a, c, t, g, unknown or other
  misc_feature (521)..(521): n is a, c, g, or t
tcagtacagatcgtcacgaccggtgctcgatttagactcatctacagggaaagggggcaggagtcagtcccaaccaggacacagcatggacatgagggtccctgctcagctcctggggctcctgctgctctggctctcaggtgccagatgtgacatccagatgacccagtcctccatccttcctgtctgcatcgtgtgggagacagagtcaaccatcacttgccgaggctagtcaggactattaactacttaatttaattggtatacaacagaaatcgaacggacaaaacgtacccctaaaactccctagtataccttaacgaatcactaatacctaaagtttacggaaaccgtacggggtacccaagtacgaagtattacgaaggtaggaaggtaggagttcggtagggaactagtacttttacttacaccatcagtacgcgtcctagacacgtacctagaaagtattaacttcggaactaaacttaacttaacttaacgtacgtaactaaactaaattntaagtatacgtacttccggaacttagtacgttacttacgtttacggaccggaacgggtaccttaaggtggaacgtaataacgtaagtcggtaaacg

SEQ ID NO: 279806 - DNA, 795 bp, Homo sapiens
  misc_feature: GYAE6OF01DX0PR.35.46.E02.1.454.CMB.1.raw
  modified_base (784)..(784): a, c, t, g, unknown or other
  misc_feature (784)..(784): n is a, c, g, or t
tcagtacagatcgtcacgaccggtgctcgatttagactcatctacagggaaaggggctttgcctgatttctgttgataccaattttaaaatagggagtttaaatgtctctctcgtctctcgtctctctgtgcagatgtgtacatacacgatagaccacgtactcctactccttcctcgttcttcgtctactcgtcgttgggtaggacgagaacgtacaccactactacttacgtaccgacggtacgtacgtactacggtaacgtaacttaacttaccttaatttaaacgtttagttaattactaaactaaagtaaactacgaacggaacgaaaccgtacccctaaaccttacctctaatccttaagtactagctatactaacgttaggtaaccggaacgggttcccgtaactagtaacgtaagtttccgtaagggtaggtaaggtagggtactagttcggggaacgttaacgttattttttaaccttttacacctaaacgtacaacgccgtaacgtccctaaggttccgaacgtccctagggtaaagttattaacttacggtaaaccaaactaaagtttaaccttttacttaaccgttaactaaaacctaaagtttagtttaacgaagtttacggttaacctttccgtaacccggttaaactcgggtttttaacgtaaccgtttttcggggaacccggtaacgggggtaccgttaaaagttcgggaattaacgtacgtaaacttaagtcggtaggtcggtacacggttacacccttatcggttnttccccgttac

SEQ ID NO: 279807 - DNA, 656 bp, Homo sapiens
  misc_feature: GYAE6OF01EWS4D.35.46.E02.1.454.CMB.1.raw
  modified_base (200)..(200): a, c, t, g, unknown or other
  misc_feature (200)..(200): n is a, c, g, or t
tcagtacagatcgtcacgaccggtgctcgatttagactcatctacagggaaagggggcaggagtcagtcccaaccaggacacagcatggacatgagggtccctgctcagctcctggggctcctgctgctctggctctcaggtgccagatgtgacatccagatgacccagtctccatccttcctgtctgcatctgtggganacagagtcaccatcacttgccaggctagtcacgactattaacctccttaatttaaacttggtatacaacagaaatcaggacaaacgtacccctaaactcctagatactacgatcgacactacctaagtttacggaaacgtacggggtaccccaagtacggaacgtagtttcgaaggttagggaaggttgggaacttcggtaggggtaacctaggtttaacttttttacgtttaccctaacctaattacgaacgtcgtaacgtcctacgacctacggtacccgtagtaaacgtatttaacgttcgaacctaaactacttaactttaacgttacgtactaaaacctaagtttaactagtaacttcgtaacctttcccgtaccttattacggtttaaccttacgttttacgggccgtaacgggtaacctaaggtacgtaagtatacgtaagtccgtaag

SEQ ID NO: 279808 - DNA, 861 bp, Homo sapiens
  misc_feature: GYAE6OF01CP0TT.35.46.E02.1.454.CMB.1.raw
tcagtacagatcgtcacgaccggtgctcgatttagactcatctacaggggaaagggggcaggagtcacgtcccaaccaggacacagcatggacatgacgggtcctgctcagctccgtggggcctctgctgctcgtcggctcgtcgaggtcgcgagtatgtacgacactaccgagacgtcgaccgtacgtcctacctctttccttccttgtctcgtactacgtcggttagggagggaacaacgtaacggtacgttaccgaacctactaccgtacgttccggaacgtacggtaccgttaaggtaccgaacggttaacttaaaccgtttaaactttaaccttttaaaagtttaagtttaccggtaactaaaccgtaaagtaacggtaaacttaccggaaacggtaaaccctaaaaccgtaccctttaaaccgtaccgtaagtaccgttaacgtacgactaaccgacttacgttaactaacggttaacggaaccggtccggaaccgttacggtacgaacgttaacgttacgtaagggtaaggtaggggtaacgtcggtaacggtacgggttaaactttaactttacgttttaccgtaaccttaactacgttaccaacggttaccgtcgtaacccggtagacccgttaacgtacgttaagtaacggttacttaattaacccgaatttaacttaacggttaactttaactaaacgtaacgtaagttaacgtaacgttacggtaactacggttaaccgtactaacggtttcgttaaccggttaaccggttacggtaacggtaaacggggtaccggttaacgttaacgggtaacgtaacgttaacgtaaaccggtcgtaacgggtaccg

SEQ ID NO: 279809 - DNA, 836 bp, Homo sapiens
  misc_feature: GYAE6OF01AVKS9.35.46.E02.1.454.CMB.1.raw
  modified_base (817)..(817): a, c, t, g, unknown or other
  misc_feature (817)..(817): n is a, c, g, or t
  modified_base (823)..(823): a, c, t, g, unknown or other
  misc_feature (823)..(823): n is a, c, g, or t
tcagtacagatcgtcacgaccggtgctcgatttagactcatctacaggggaaagggggcaggacgtcagtcccaaccaggacacagcatggacactgaggtccctgctcgagcctccgtgggctcctgctgctctggctctcaggtgccagatgtgaccatcccagactcgaccctagttcctcctatcccttcctggttctgcattccgtggtagggactaccgtaggaccgttaccaaccgtacgttaccgtaaccgttttcggacccggtaaggtccgttacggttaccgtaacgggtaaccttaacgtttaaaccctttaccgtttaaaagtttttaaaaaccggttacggggttaaaccttaaaccgtaaaaccggtaaacggttaaaaccttacccggtaaacggggtaaccctaaaaacccggttacccccctttaaaacgtttaccccgttaacggtaacgttacccgttaaccggtaacttaccgggtaaccttaacgttaccgttaaaaggttttaccggaaaaccggttaccgggtaccctaacgttacgggtaacgtacgtttaccggtaagggttaggtaaacggttacggtacgttaccggttaagggtaacttaacgtttaacctttttaccgtccaaaccgtagtacgtacggtaccctaagttccgtacgtacgacgttaccgtaaggtaactacttagtacctaacgtaacttagttacttaatccgtaacctaattagtacgtgacttacgtctacgtacaagttcgtaccttggttaagcggtacggataccggtanacgtancgtaatccgtcgg

SEQ ID NO: 279810 - DNA, 761 bp, Homo sapiens
  misc_feature: GYAE6OF01COFNR.35.46.E02.1.454.CMB.1.raw
  modified_base (143)..(143): a, c, t, g, unknown or other
  misc_feature (143)..(143): n is a, c, g, or t
  modified_base (149)..(149): a, c, t, g, unknown or other
  misc_feature (149)..(149): n is a, c, g, or t
  modified_base (163)..(163): a, c, t, g, unknown or other
  misc_feature (163)..(163): n is a, c, g, or t
  modified_base (195)..(195): a, c, t, g, unknown or other
  misc_feature (195)..(195): n is a, c, g, or t
tcagtacagatcgtcacgaccggtgctcgatttagactcatctacagggaaagggggcaggagtcagtcccaaccaggacacagcatggacatgaggtcctgctcagctccgtggggctcctgctgctcgtggctctcaggtnccagtntgtgactatccagntacgacctagtcctctacttcccttcgtgtcngactagttcgtggtagggagtacgaaggtcttccaacctatcgtacgttcggaccagggtactgtacgaggtaactaacttaccgttaccttaagtttaacgttacggtacttaacgaaactaggtaaattaccggaagtaaccaaaaccgtccctaaactcgtactacgttcgacgtacgtacgactattaccgtaagttaacggaccgttacgggacctaaggtacgtagttccgttaagtacggtaggaacggttcggtacgtaggtacggtaacttagtttacgtttacctacgtactctacgtactccgtacgtacgtacggtactacgacgtttagaacgttacttaacgtacgtaacttaagtactttaacgtaacgttaacctaacgtaaacttagtacgttaacgggtactaaccgtttacgggttacctaacgttacgttaacccggtttaacgttacccgggtttaaccgggtaaaccggtaccgggggttaacttaaggggttaaacccgttaggaaacccgtttaaagtaccccgggttaaaggttacccggg

SEQ ID NO: 279811 - DNA, 777 bp, Homo sapiens
  misc_feature: GYAE6OF01A6HL0.35.46.E02.1.454.CMB.1.raw
  modified_base (175)..(175): a, c, t, g, unknown or other
  misc_feature (175)..(175): n is a, c, g, or t
tcagtacagatcgtcacgaccggtgctcgatttagactcatctacagggaaagggggcaggagtcagtcccaaccaggacacagcatggacatgaggtccctgctcagctccgtgggcctctgctgctcgtgctctcgaggtcgccgagtatgtcgacatcagatcgaccagtcncctacttccgttcctgtctgctagtcgtggtaggacgactaggactaccaacctatacgtaccgttacgcctagggtacgttaaggtacgaacgtaacttaacgtttaaccttacgtttaaactttaaggttacgtaactaaccgaaagtaagtaaacgtacgaaacccgtaaccgtaaaaccccgttaaccctaaccgttcgacgttaacctacgtacgttacgactaccgtaacgtttaacgttaaacgggttaacggaaccggttaccggtaaccctaacgggtagtaacgttaccggtagtaagggttacggtaaggtacggtacgtacgggtacggttaacttacgttttacctttacgtaactacgtatacgtctacgaaccgtcgacgtactacggttacgaaggtaacgttattacgtaacgtaactaagtttacgttacgtaacgttaacgtaaacttaacgagttactacggttaacgtccgttaaccttaccgtacgttacgtacgtaccggttttacgggtacccgggaacgggtaacccgggttaatacgggttaacggtacttaacggtaccgtaaggttcgtaacgg

SEQ ID NO: 279812 - DNA, 795 bp, Homo sapiens
  misc_feature: GYAE6OF01BX41O.35.46.E02.1.454.CMB.1.raw
  modified_base (86)..(86): a, c, t, g, unknown or other
  misc_feature (86)..(86): n is a, c, g, or t
tcagtacagatcgtcacgaccggtgctcgatttagactcatctacaggggaaagggggcaggagtcagtcccaaccaggacacagnatggacatgagggtccctgctcagctccgtggggctcctgctgcttctggctctcgaggtcgccagatggtgacactccagactcgaccctagtcctcctacttcccttcctgtcctgctatcgtggtagggacgacaggtacgtaccacctactcgtaccgttcgaccgaggtcgtacgtacgaaggaccttaacttaaccttacctttaagttttaaagttggtaacttaaccaacgtaagtaaacgtcgaacggtaaccaaacccgtacccccttaaacctccgtagaaccttaccgtaacgagttacgcttaacgtaccttaaaggttaccgggaaaccggacgggtaccctagtacggaacgttagtacccgtaagggttacgggtaacgttacgggtagttaccgggtagtaacgtttaactttaaccgtttttaacttacccggtaaccttaacgggtacgtaacgtaccgtaaccggtaccgtacgtaaccggtaaccgtaccggtaagtaacgtactttagtaaccgtaactaaattacgttaattaccgtacgtaaccttaaacgtattacgtagttaacggtaacgtacccgttacgtaaccgtacgtttaccgttacgttacgggttaccgggacccgggttaacgggtaaaccttagggtacgggttactaagttcgtaaacggttcggtaaccgg

SEQ ID NO: 279813 - DNA, 1006 bp, Homo sapiens
  misc_feature: GYAE6OF01CLNZG.35.46.E02.1.454.CMB.1.raw
tcagtacagatcgtcacgaccggtgctcgatttagactcatctacagggaaagggggcaggagtcagtcccaaccaggacacagcatggacatgagggtccctgctcagctccgtggggctcctgctgctctggctctcaggtgccagatgtgactatccagatcgacccagtcctcctacgttccttcctgtcctgctacttcgtggtagggagacgagtacgtaccaacctattacctaacgttcgaccgtaggtacctaggttaccgaaggtaccttaacttttaaacccttaaccgttttaaaagttttaaaacgtttcggtaacttaaccgtaaaccgtaaagtaaaacgtacggtaaccggtaaaccctaaaaccccgttaaacccccttaaaacccgtccgttaacggtaacctttaccggtaaaccggtacttaccggtaaccttaaccgttaacccgttaaaagggtttttaaacccgggaaaacccgggttacccgggggtaacccctaacggttaacccggtaaagtttaaccggtttaaccggtaaggggtaagggtttaaacggggttcggtaaccggtttaccgggtaacgggttaaacgtttacggttttaaaccttttttaaccccgttaccgtaacccgttactaaccggtaccgtaacccgttacccgggtaccgtttaccgaccgggttaaccctaaccggtttaaggtaaaccggtttaatttaccggttaaacccgaaccgttaaacttaaacgtttttaaccgttaaccgttaaccggtaaaacttaaaaccgttaagtttaacgttaacggtacgtttaacccggttaacccgttaccggttaaacccgttaagtttaaacccccgggtttaacggttttaaccggtttaaccggggggtaacccggtaaacgggggttaaaaaccctttgggtaacccggttaaagtaccctaaaacgggttaccgtttaacgggtaaacgg

SEQ ID NO: 279814 - DNA, 741 bp, Homo sapiens
  misc_feature: GYAE6OF01B7B54.35.46.E02.1.454.CMB.1.raw
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
tcagtacagatcgtcacgaccggtgctcgatttagactcatctacagggaaagggggcaggagtcagtcccaaccaggacacagcatggacatgagggtccctgctcagctcctggggctcctgctgctctggctctcgaggtgccagatgtcgacatccaagatcgacccagtcctacctacttcccttcctgtcctgactagtctggtgggacacgagacgtaccactactctactcgacaggctagcaggactacttaacgtcttaatttaatgtactacgaananaatcgaacgacaacgtaccctaactctatactctacgatcgtactactacgtagtaacggaacggtacggtaccagtaccgtagtacgttacgacggtaggaagtcgtagtacggtacggtacgttagttaacgtttttacctacgaaccgttataccgaacgtaccgtaacggtcccttacggaaccgtacgggttaacccgtaacgggttaaaacgttcttaaacggttaccgtaacgtttaaacccgttaattaacccgttttaacgtaaccggttaaacctaaacgtaaacgtttacgtaacgtacgttaccggtaccgttacgtaaaccttacgttacccggtttaaacgttcccgggtttacgggaaacccgggttaccggtaaaccgttacgggtttaacggacgtttaaaccgttaacgtaaaccgggttggtttaaacccggg

SEQ ID NO: 279815 - DNA, 509 bp, Homo sapiens
  misc_feature: GYAE6OF02H2TXG.35.46.E02.1.454.CMB.1.raw
tcagtacagatcgtcacgaccggtgctcgatttagactcatctacagggaaagggggcaggagtcagtcccaaccaggacacagcatggacatgagggtccctgctcagctcctggggctcctgctgctctggctctcaggtgccagatgtgacatccagatgacccagtctccatccttcctgtctgcatctgtgggagacagagtcaccatcacttgccaggctagtcaggacattaactccttaatttaaattggtatcaacagaaatcaaggacaaacgcccctaaactcctgactctacgatgacataccaatttacggaaacgacgggtacccagtacgagattcagtggagtgatcgtggacagtattttacttcaccatcagcagctgcagtcctagaagtattattcgacaactattattactgtactaaacatatgatgacttcgacattgtaactacgtttgaccgtagggacctaaggtggatatactatcgtaacg

SEQ ID NO: 279816 - DNA, 706 bp, Homo sapiens
  misc_feature: GYAE6OF02F2U5A.35.46.E02.1.454.CMB.1.raw
  modified_base (200)..(200): a, c, t, g, unknown or other
  misc_feature (200)..(200): n is a, c, g, or t
tcagtacagatcgtcacgaccggtgctcgatttagactcatctacagggaaagggggcaggagtcagtcccaaccaggacacagcatggacatgagggtccctgctcagctcctggggctcctgctgctctggctctcaggtgccagatgtgacatccagatgacccagtctccatccttcctgtctgcatctgtggganacagagtcaccatcacttgccaggctagtcaggacattaactcctatttaaattgtatcaacagaaatcaggacaaacgacccctaaactcctagactactacgatgacatcctaatttagggaaactacggggtacccagtacgaagtactttcaaggttaggaaggtcggaagttccgtaggggaacctaaggttaacttttttaaccgttttaccgaacccgtaaattccgtaaggtaccgtaacggtacccgttacggacctaaccgggtacccgttaagaaacgggtaaactttaacgttcggtaaccaaaaccgttaactttaacgttttaaacccgtaggtttaacccaaaacgttaaacgttaagttaagaacgtttacgggtacctttacccggtaccctaagttacggttaacccttacgtttttacgggacccggtaacgggggtaacctaacgggtttacgggaaacgtacgttacgtaacttacggtaaacgg

SEQ ID NO: 279817 - DNA, 808 bp, Homo sapiens
  misc_feature: GYAE6OF02I2RVZ.35.46.E02.1.454.CMB.1.raw
  modified_base (196)..(196): a, c, t, g, unknown or other
  misc_feature (196)..(196): n is a, c, g, or t
tcagtacagatcgtcacgaccggtgctcgatttagactcatctacagggaaaggggcaggagtcagtcccaaccaggacacagcatggacatgagggtccctgctcagctcctgggctcctgctgctctggctctcaggtgccagatgtgacatccagatgacccagtctccatccttctgtactgctatctggtnggacgacgacgagtaccacctactactacgtacgtaccgacgtctaaggtcctaaggtaacctaacgtttaaaccttaaccctaagttttaaaactttacggttaaacttaccgtaaaactaacgtaaaacgtaccgtaaacggtaccgtaaaaacggtacccccgttaaaaccgttacccgttaacgtaacgttaccgttaaccgtaacgttacgtacctaacgttacccgtaaaacgttttaacgggtaaaaccgtaacggggttaacccgtaacgttaccggtaacgtaacgttacgtaacggttacgggtaaacgttacggtaacgtacgttacgggtaacgttaacggttaacgttttaaccgtttacgttaacccgtaacgtaccgtaacgtaccgtaacgtaccgtacgtaccgtacgtaccgtacgtaacgtaactagttacgtacgtaactaacgttaacttaacgttaacgttaacgtaaacgtaaacttaagtacgtaacgtaacgttacgttacgtactaatcgtacctacgttttacggtaccgtaaggggtaccgtaacggtttacggtaacggtaacggttaccgtaaacggtaacg

SEQ ID NO: 279818 - DNA, 620 bp, Homo sapiens
  misc_feature: GYAE6OF02JGWE7.35.46.E02.1.454.CMB.1.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
  modified_base (380)..(380): a, c, t, g, unknown or other
  misc_feature (380)..(380): n is a, c, g, or t
tcagtacagatcgtcacgaccggtgctcgatttagactcatctacagggaaagggggcaggagtcagtcccaaccaggacacagcatggacatgaggtcctgctcagctcctggggctcctgctgctcgtggctctcaggtgccagatgtgacatccagtatcgacccagtcctccattcccgtctgtctagcntcgtggtacgggactacgagtacgtccacctatcgacttcgaccgagtctagtcgagactatactactatttaagtgtanacaagataancagaccaacaccctaactctagtactcgtaatancgtacactacttaagttagaaccgtacggtccataggacgtactacgtaggtaagtaacggngtacgttacggacggtatagttaccttttaccttacgtacctactacgtacgtcgtacgtaccgtcgacgtacccgtgtaacgtagttactattacgactaactaacgttaattaccttgtaacctattaactaatgttaacaacttccgtacgtaccttaatacgttaacgttcgtttacggaccgggttaacggaaccgttacggacggtaagtaccgtaaacgtacgttagtaccgg

SEQ ID NO: 279819 - DNA, 685 bp, Homo sapiens
  misc_feature: GYAE6OF02I8HH8.35.46.E02.1.454.CMB.1.raw
tcagtacagatcgtcacgaccggtgctcgatttagactcatctacagggaaagggggcaggagtcagtcccaaccaggacacagcatggacatgagggtccctgctcagctcctggggctcctgctgctctggcctctcaggtgccagatgtgacatccagatgacccagtctccatccttcctgtcctagccatctggtagggacacagagtccaaccatactacttgccaggtctagtcaggacataactacttaatttaaatgtatacaacagtaaatcaaggacaaacgtacccctaaactcctagtactactacgaatcgacacttactaagtttacgaaaacggtaccgggttacccaagtcggaacgttacgttcgaacggtaggaaacggtggtaactggtacggatacgttaactttttacgtactaacctaattcgacgtactacggtcctcgacgtacgccgttaaggaacgtattacttagaactaaccgttaattacgttacgttaaccgaacctaaagttaaagttacgttacggtaacgttaaccgttaccgttaccgacccttaaggtttaaccgttacccgtttaaaccggttttcgggaacccggtaaacgggggtaacctaacggggtttcggtaagtacgttaccgtaagttaccggttaaccgg

SEQ ID NO: 279820 - DNA, 559 bp, Homo sapiens
  misc_feature: GYAE6OF02G83P9.35.46.E02.1.454.CMB.1.raw
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
tcagtacagatcgtcacgaccggtgctcgatttagactcatctacagggaaagggggcaggagtcagtcccaaccaggacacagcatggacatgagggtccctgctcagctcctggggctcctgctgctctggctctcaggtgccagatgtgacatccagatgacccagtctccatccttcctgtctgcatctggtgggagacagagtcaccatcacttgccaggtctagtcaggacattaactcctaatttaaatggtatcaanagaatcagcaaagtcccctaaaatcctgactctacgntgcactccaagtttggaaactcgggtcccagtcgagatcaagtgaagtggatcgaggacagtacttttctacactatcacgcagtcctgcacgtccgtagaagtcttatcaacgtaactagttaacttaactgtaactaaacctaagttatagactttacggacttaccgccgttaatacggtaaccttacgttttcggaaccggtaacgggtaccctaagggttggaactaacgtaaccgtagtaccggtaaccgg

SEQ ID NO: 279821 - DNA, 691 bp, Homo sapiens
  misc_feature: GYAE6OF02I0YU1.35.46.E02.1.454.CMB.1.raw
  modified_base (299)..(299): a, c, t, g, unknown or other
  misc_feature (299)..(299): n is a, c, g, or t
tcagtacagatcgtcacgaccggtgctcgatttagactcatctacaggggaaagggggcaggagtcagtcccaaccaggacacagcatggacatgagggtccctgctcagctcctggggctcctgctgctctggctctcaggtcgccagatgtgacatccagatcgacccagtcctcccctccaccctgtctgcatctaggtaggagacaggcgtactacttattacgttggtcgggcctagtgaagagtaataaggttaggttgggtgcttggtatcagcaacgaaacgagggaaacnccctaagctctgtatagtagtagggtcttctgtactaacaaaggtcgggaccaacgtacggtcacgcgagagtggattcggaggtacaagtaacttccgacttaccacctaacctagtaccaagtacgccttacgaccacggtaccctagtattacgttaaccgtttagtacctaaaccttcttaaccgtacgtaaccctaaacgttaacttaaccgaacgttacccttaacttttaaccgttttccgtttacccggttaccgggggtaaccggggtaaccgggtaacccgggtaaaaggttccgggtaaaccttaaccgtaacggtaaacggaaccggttaacggttcggttaccggtacccggttcaaccccgttacgtacctttaccgg

SEQ ID NO: 279822 - DNA, 796 bp, Homo sapiens
  misc_feature: GYAE6OF02FFPBE.35.46.E02.1.454.CMB.1.raw
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
  modified_base (616)..(616): a, c, t, g, unknown or other
  misc_feature (616)..(616): n is a, c, g, or t
tcagtacagatcgtcacgaccggtgctcgatttagactcatctacagggaaagggggcaggagtcagccccaaccaggacacagcatggacatgagggtccctgctcagctcctggggctcctgctgctctggctctcaggtgccagatgtgacatccagactcgaccctagtcctcccacttcccgtttcctggttctacgctagtcgtggtcgggacactacgtacgtcaacctctcctacgttcgaccgaggtacctagtaccgacgtaactacgtttaaccttacctttaatttttaaaacggtcggttactaaaccgaaacctaacggtaaactaccggaaaccggtaacctaaacccggtaaccccctaaaattccgtaacggttactaccgttaccgttaactacgttacgaccgttaaacccgttaaccgttaaacgggttacccggaaacggtaccggtacccagtacgtacgtacgttcgaggtacggtagttacggacgttggacgtaccttacgtttaacttttaccgactcgtaanccgngtaccgacncgtaccgacgtacggtcaacggttaataccgttaactaccgtacttaaacgttntacgtttaactacgtaaacttaaagtacgttaacttaaccggtaagttaccccgttaaccgtacgttaacgtttaccgttaacccggtttaacccggtttaacccggggtaaccggtacccggggtaaacccggtaacgggttaaccggtagtaccctaggttaacctaccggtaaccgg

SEQ ID NO: 279823 - DNA, 842 bp, Homo sapiens
  misc_feature: GYAE6OF02HS952.35.46.E02.1.454.CMB.1.raw
  modified_base (403)..(403): a, c, t, g, unknown or other
  misc_feature (403)..(403): n is a, c, g, or t
  modified_base (690)..(690): a, c, t, g, unknown or other
  misc_feature (690)..(690): n is a, c, g, or t
tcagtacagatcgtcacgaccggtgctcgatttagactcatctacagggaaaggggctttgcctgatttctgttgataccaaattttaaaatagggagtttaaatgtctctcgtcgtctcgttcggtctctctacggtcgtccgacgatagtgactactaccgtactagtacgtacccgtaacgtctaccctaaccttacccttcccttcgttccgtcgtacctacgttccttggtgggtaacggacgaacgtacgtaccgacctactactaaccttcgaccgtacgtaccggttagtacgtacggaactacgtaaccttaccttaactttaaactttaacgttagtaactaactaaacgtaacaacgtaagaacccgtaaaccaacccgtaaccttaccctnaagttccctaacgattacgcccgtaaattacccgtaaacgttagggtaaaccctaaacgggggtcccccggtaaattaccgggtacgagttaccggtaaggtaacggtagggtacggttaggcggttacggaacttagtaacgttttttacctaacgtacccagttaactcggaccaggtaccctcacccggtacgtacgtaccgtaaagtacggtaacgttagtaccgtaactaacgttaaccttactaacgttaaactaactaagtaactaacgtagtaaccgtnttacccgtacgtaccttaggttaacgttacgtttaaccggtacgggtaaccggtaacgttaaccgggagtttaaggacttaacggtaaactacggtaacggtacgttaggcttaaccggtctacgttaaccttacggttcccgttaattccg

SEQ ID NO: 279824 - DNA, 770 bp, Homo sapiens
  misc_feature: GYAE6OF02HQAYG.35.46.E02.1.454.CMB.1.raw
  modified_base (220)..(220): a, c, t, g, unknown or other
  misc_feature (220)..(220): n is a, c, g, or t
  modified_base (647)..(647): a, c, t, g, unknown or other
  misc_feature (647)..(647): n is a, c, g, or t
  modified_base (671)..(671): a, c, t, g, unknown or other
  misc_feature (671)..(671): n is a, c, g, or t
tcagtacagatcgtcacgaccggtgctcgatttagactcatctacagggaaagggggcaggagtcagtcccaaccaggacacagcatggacatgacgggtccctgctcagctcctggggctcgtgctgctcgtgctctcgaggtcgaccagtacgtggtagacctataccaggtactacggacccagttcctaccctctttcccttccgttagtccgtancgtacttcgtgggtagggacgacgtaagaccgtaccaacctacgttcctaacgttcgaccgtacggtacgttacgacgtacggtaactaaccttaccgttacttaaattttaacgtagtaacgtaactaacgtaacgtaaatccgaacggaaaccctaaaccgtaaccccgtaacgtacccgtagtaacgttaccgtaacgacgtaacgaccgttaacttaaccgttaagttaacgggaaccggtaccgggtacctaacggtacgtacggttacctacggtaacggtacgggtaagttacgtagtccgggtaggtaacgtttcgttttaaccgtttccttaccaacgttactaccgcggtacctaacggtaccgtagacccgttaacgtcggtaaggtaaactcggttaacgtaccgagtaaacttnttaaccgtatacgaataaacgttnttacacgtaatccttacgcgacgttgtaaaccgtggtttaccctaaggggtccgtaacgggtaacgtaggtaacgccgtaagttacccgagttacggtg

SEQ ID NO: 279825 - DNA, 478 bp, Homo sapiens
  misc_feature: GYAE6OF01CBW7B.35.69.G03.1.454.CMB.1.raw
  modified_base (453)..(453): a, c, t, g, unknown or other
  misc_feature (453)..(453): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccaggagaagcccctaactactgatgtatactgtatctactttgcatattgcgtccatcaaggttcagtggcagtggatctgggacagatttcactctcacatcaacaatatacaacctgaagactttgactaacttactactgtacaacagacttacaggcccattcacttcgcctggaccanagtccatatccaacgactgtgctgc

SEQ ID NO: 279826 - DNA, 500 bp, Homo sapiens
  misc_feature: GYAE6OF01B2LWY.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaattggtatcgccagaggccaggagaagcccctaactactgatgtatactgtatctactttgcatattgcgtcccatcaaggttcagtgcagtggatcgtgggacagatttcactctcaccatacaacaatatacaacctgaagtactttagactaacttactactgtacaactagacttacacggccctattctactttcggccctgggaccacacgtccatactaccaacgaactgtcggctgacc

SEQ ID NO: 279827 - DNA, 505 bp, Homo sapiens
  misc_feature: GYAE6OF01CWZMB.35.69.G03.1.454.CMB.1.raw
  modified_base (472)..(472): a, c, t, g, unknown or other
  misc_feature (472)..(472): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaattggtatcgccagaggccaggagaagcccctaaactactgatgtatactgtatctactttgcatattgcgtccatcaaggttcagtgcagtggatctgggacagtatttcactctcacctatacaaacaatactaacaacctgaagtactttgactaacttactaactgtacaacagacttacgacggcccctattcactttccggccctgggaccanacgtccatactccaaacgaactgtcggctgacc

SEQ ID NO: 279828 - DNA, 529 bp, Homo sapiens
  misc_feature: GYAE6OF01AB8J6.35.69.G03.1.454.CMB.1.raw
  modified_base (277)..(277): a, c, t, g, unknown or other
  misc_feature (277)..(277): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccaggganaacgcccctaaactactgatgtatactgtatctactttgctatattgcgtccatcaagttcagtgcagtggatcgtgggacagtatttcactctcaccatcaaacaatatacaacctgaagtactttgactaacttactactgtacaactagtaccttacgacgggtcccctagtttccacgttttccggcccgttagggacccacgtacgtcccaattacctacccaaacgtactggtcggccttcgaccc

SEQ ID NO: 279829 - DNA, 490 bp, Homo sapiens
  misc_feature: GYAE6OF01BP8EM.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaattggtatcgccagaggccaggagaacgcccctaactactgatgtatactgtatctactttgcatattgcgtccatcaagttcagtgcagtgatcgtgggacagtattcactctcacatcaacaatatacaactgaacgtactttgctaacttactactagtacaactagtacttacagggccccattcactttcgcctacggaccacacgtccatacaccaacgactgtgctgacc

SEQ ID NO: 279830 - DNA, 542 bp, Homo sapiens
  misc_feature: GYAE6OF01DNUA4.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtctgcatctgtcggagacagagtcaccatcacttgccgggcaagtcagaccattcgcgtcttaatttaaattggtatcgccagaggccagggagaacgcccctaaactactgatgtatactgtatctactttgctatattgcgtcccatcgaagttcagtggcaggtggatcgtagggacagtatttcactctcaccatacaacaatactaacaacctgaactactttagactaactttactactgtacaactagtaaccttacgacgggtcccctagttccctacgtttccggccctaggggacccaactacgtacccaattactacccgaaacgtactggtcggcttcggacc

SEQ ID NO: 279831 - DNA, 587 bp, Homo sapiens
  misc_feature: GYAE6OF01CNPYN.35.69.G03.1.454.CMB.1.raw
  modified_base (226)..(226): a, c, t, g, unknown or other
  misc_feature (226)..(226): n is a, c, g, or t
  modified_base (279)..(279): a, c, t, g, unknown or other
  misc_feature (279)..(279): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccggnaagtcagacctattcgcgtactaatttaaattggtatcgccagaggccagganaacgcccctaaactactgatgtatactgtatctacttgactattattgacgtcccatcaagttcagtgcagtgatcgtgggacagtatttcactctacacctatacaaactaatactaacaactagtaacgtactttacgactaacttacttactagtaccaacgtaacgtaccttaacgaaccgggtacccctaagtttacctaccgttttcccgggaccccttacggggaacccctacgtacgttaccctaacgttaaccgttacccgtaaaaccggtaaccttaggtacggtcttacggtaaccc

SEQ ID NO: 279832 - DNA, 525 bp, Homo sapiens
  misc_feature: GYAE6OF01BE26F.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaatggtatcgccagaggccaggagaacgcccctaactactgatgtatactgtatctactttgctatatgcgtccatcaaggttcagtgctagtggatcgtgggactagtatttcactctcaccatacaaacatactaacaacctgaacgtactttcgactaacttactactagtacaactagtaccttacgaccggtaccctattcctacgtttccggacccgtacgggaccctacgacgtccaatactacccaacgtactggtcgtctcgacc

SEQ ID NO: 279833 - DNA, 556 bp, Homo sapiens
  misc_feature: GYAE6OF01C39KC.35.69.G03.1.454.CMB.1.raw
  modified_base (107)..(107): a, c, t, g, unknown or other
  misc_feature (107)..(107): n is a, c, g, or t
  modified_base (226)..(226): a, c, t, g, unknown or other
  misc_feature (226)..(226): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagtacagatcgtcacgaccggtgctcgatttagtcgctgcgtaaaggagaaagggggcaggagtcagtctcagtcaggacacagcatggacatgaggctccccgntcagctcctggggctcctgctactctggctccgaggtgccagatgtgacatccagatgacccagtctccagccctccctgtctgcatctgtcggagacagatcaccatcactggccggnaagtcaagccattcgcgttacttaattttaaatggtatcgccaggacggccaagggaacaacgccccttaactactgattgtaattactagtaatccttactttgactattattcggccgtaccatcgtaagttcagtgnagtgatcgnggatagtattcactctacaactataacaaacaataactaaccaacctagaacgtactttacgactaactttaactactacgtacaactagtacttacgaccggaccctattcctacgttccgacctacgggacccagtacgtacctaactactaccaaaccgtaactgtacgctgtaaccc

SEQ ID NO: 279834 - DNA, 591 bp, Homo sapiens
  misc_feature: GYAE6OF01BAQCG.35.69.G03.1.454.CMB.1.raw
  modified_base (226)..(226): a, c, t, g, unknown or other
  misc_feature (226)..(226): n is a, c, g, or t
  modified_base (282)..(282): a, c, t, g, unknown or other
  misc_feature (282)..(282): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccggnaagtcagaccattcgcgtacttaatttaaagttggtatcgaccagaggccaagganaacgcccctaactactgatgtatactgtattcttactttgactagttacttcgccggtaccctatacgtaaaggtttccaggtcggactaaggttcggaacttcgagggaactaggtactttcacttcctactaacctatacaaactaattactaaccaacctagtaacgtactttcgaactaactttacgtactacgtacaaactacgtaaccttacgaccggtaccctagttacctaccgtttccggacccgttacgggaaccctacgacgtaccaactactacccaaacgtactggtgccgtgacc

SEQ ID NO: 279835 - DNA, 549 bp, Homo sapiens
  misc_feature: GYAE6OF01AWY9P.35.69.G03.1.454.CMB.1.raw
  modified_base (364)..(364): a, c, t, g, unknown or other
  misc_feature (364)..(364): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgttactatttaaattggtatcgccagaggccaggagaacgcccctaactactgatgtatactgtatctactttgctatattgcgtcccatctaaggtcagtgcagtggatcgtggacagtnttcactctacacatacaactaatactaacctaacctagtaacgtactttagactaactttactaactctacaactacgtaaccttacgaccggtacccctattaccctacgtttcccgacccgtagggaccctactacgtccaacttactaacccgtaacgtaacttaggtcggtcctcgtaccc

SEQ ID NO: 279836 - DNA, 673 bp, Homo sapiens
  misc_feature: GYAE6OF01C91Y4.35.69.G03.1.454.CMB.1.raw
  modified_base (154)..(154): a, c, t, g, unknown or other
  misc_feature (154)..(154): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccggaggtgccagatgngacatccagatgacccagtctccagccctccctgtctgcatctgtcggagacagagtccaccatcacgttcggccgggcaacgtcaacgacctattcgcgttacttaattttaaattggtatcgaccaggacggccaggaacgaacgcccctaaactactagatgtatacttgtaactcttactttgactattagttcgccggtacccattacgtaaggttcaggtggctaggtggtattcggtagggtactagttactttccacttcctacaccctatacctaaactaacttaactaacctaaaccgtagaaacgtttactttacgacccttaaacctttactacgttacgtaccctaaacgtacgttaacccttaacggacccgggttaccccttaacgttttacccgtacccgtttccccgggacccgttaccggggaaacccctacggttaccgtacccttaaagtaccctaacccgtaaaccggtacggttcggtaccgggcttcggtaacccc

SEQ ID NO: 279837 - DNA, 552 bp, Homo sapiens
  misc_feature: GYAE6OF01B3DCA.35.69.G03.1.454.CMB.1.raw
  modified_base (313)..(313): a, c, t, g, unknown or other
  misc_feature (313)..(313): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctgggctcctgctactctggctccgaggtgccagatgtgacatccagatgacccagtctccagccctccctgtctgcatctgtcggagacagagtcaccatcacgttgccgggcaagtcagaccattcgcgtcttaatttaaatgtatcgcagagcaggagaacgcccctaactactgatgtatactgtatctactttnctatatgcgtcccatctaaggttcagtgctaggtgatcgtgggactagtactttcactctcacctaataccaaactaataactaaccaaccgttagaacgtactttacgacttaacttactactacgtacaactagtaaccttacgaccggtaccctagtttacctaccgtttccgggacccttacgggaccctaacacgtacccattaccaccgtaacgtactaggtcggctcggacc

SEQ ID NO: 279838 - DNA, 585 bp, Homo sapiens
  misc_feature: GYAE6OF01CMOX7.35.69.G03.1.454.CMB.1.raw
  modified_base (347)..(347): a, c, t, g, unknown or other
  misc_feature (347)..(347): n is a, c, g, or t
  modified_base (445)..(445): a, c, t, g, unknown or other
  misc_feature (445)..(445): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatcgacccagtcctccagccctccctgtctgcatctgtcggagacagagtcaccatcacgttcggccgggacaagtcacgaccaagttccgcgttacttaattttaaagttggtatccgacctaaggacggccgaagggaacgaacgtccccctaaactactgatagtatactgtattctatttnactatgttcgcgtaccatacgaagttcagtgactaggtggatcgaggactagtcttcactctacacatacaaatatacaacaacctgaactactttanaccttaacttactaactgtaaccaaacgtagtaaccttaaccgaccggtcccctaagttcccgttaccgtttcccggcccgtacgggaaccctacacgttcccaagtacctaccgtaacgtacttggtcgtcgctaaccg

SEQ ID NO: 279839 - DNA, 639 bp, Homo sapiens
  misc_feature: GYAE6OF01CW0OS.35.69.G03.1.454.CMB.1.raw
tcagtacagatcgtcacgaccggtgctcgatttagtcgctgcgtaaaggagaaagggggcaggagtcagtctcagtcaggacacagcatggacatgaggcctccccgctcagctccgtggggctcctgctactctggctccgaggtgccagatgtgacatccagatcgacccagtctccagcctccctgtctgcatctgtcggagacagagtcaccatcacttgccggataagtcagaccattcgcgtacttaatttaaatggtatcgccaggacggccaagggacaacgcccctaaacgtactggatcgtaatactgtaactctatttgctatatcgcgtacccatctaaacggttcaaggtcgtacaggtcggaatcgtagggaacagtactttcacctctacaacgtatacaaacaatacaacaactagaatacttagactaaccttaactactaacgtacaaacgtacgtaaccttacgtaaccgggtacccctaagtttacccacgttttaccccgggaccccgtttaacgggaaaccccgtaaccgtaacggtttacccctaaacgttaacccgttaacccgtaaaaacccggtaaccgtttacgggtaccggttaccgtcggtaaaaccccg

SEQ ID NO: 279840 - DNA, 665 bp, Homo sapiens
  misc_feature: GYAE6OF01DELXO.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctccgtggggctcctgctactctggctccgaggtgccagatgtgacatccagatcgacccagtctccagccctccctgtctgcatctgtcggagacagacgtcaccatcctacgttcggcccgggacaagtacaacgacctattccggacgttacttaaattttaaagttcggttaactccgaccgaggacggacccgaagggaacgtaaaccgtaccccctaaactaccgtagagttagtaattacttagttacttccttacgtttgactattacgttcggtaccggttaccctaagttacgtaaacggttctaaggtcggcgtaggtggtactcgtagggactagtacttcacctctacactatacaaatatactaactaactagaaacgttcttagacctaaacgttactactgtaaccaaacgtacgtaaccttaaccggaccggtacccctaagttaccctaccgtttaccccggccttaccgggaaccctaacgtacggttacccaagttaaccctaccgaaacgtaccttggtaccgctacgtaccc

SEQ ID NO: 279841 - DNA, 582 bp, Homo sapiens
  misc_feature: GYAE6OF01DIJ8B.35.69.G03.1.454.CMB.1.raw
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (374)..(374): a, c, t, g, unknown or other
  misc_feature (374)..(374): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtctgcatctggtcggagacagagtccaccatcacttggcccggnaagtcagaccattccgcgttctaatttaaatggtancgcagaggccaggacaacgcccctaactactgatgtactactgtatctactttgactatattgccgtcccatcaaggttcagtcgctagtggatggtagggacagtntttacactctacaactataacaaactaataactaaccaacctagaacgtacctttagacctaactttactaactcgtacaactaagtacctttacgaacgggcccctaattaccgtacgtttcccgggacccgtacggggtaacctaccgtacggttacccaacgttaacctacccgaaacggtaaccttgggtaccgctcggtaccc

SEQ ID NO: 279842 - DNA, 563 bp, Homo sapiens
  misc_feature: GYAE6OF01BI0YE.35.69.G03.1.454.CMB.1.raw
  modified_base (202)..(202): a, c, t, g, unknown or other
  misc_feature (202)..(202): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcgganacagagtcaccatcacttggccggcaagtcagaccattcgcgttacttaatttaaagttggtatacgcctagacggccaggacgaacgcccctaactactgatgtatactgtatctattgctatatcgcgtccatcaagttcagtgcagtgatcgtaggactagtattcactctacacatacaaactaatactaacaacctagaactactttagacctaacttactacttacgtactaaacgtacgtaaccttacgaccgggtacccctaattccgtaccgtttcccgggacccgttacgggaaccctacgtacgttccaacttacctaacccgtaaacgtactggtacgctacggtaccc

SEQ ID NO: 279843 - DNA, 703 bp, Homo sapiens
  misc_feature: GYAE6OF01C5F1S.35.69.G03.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
tcagtacagatcgtcacgaccggtgctcgatttagtcgctgcgtaaaggagaaagggggcaggagtcagtctcagtcaggacacagcatggacatgaggcctccccgctcagctcctggggctcctgctactctggctccgaggtgccagatgtgacatccagatcgacccagtcctccagccctccctgtcctgcatctgtcgganacagatcaccntcacgttcggccgggataagtcagaccagttcgcgttacttaatttaaagttggtatccgaccaaggacgggacccaagggaacgaaccgtaccccctaaactactgaatgtaatactgtacttcttactttgactagttagttcgaccggttacccagttaccgaaaggtttccaaggttcggacgtaggtcggtacttacggtagggtaactacgttacttttaccgaccttaccttaccaaccctaaacttaactaaaacctaaacttaacgtaaaccctaaaccttaaggtaaacggttaaccttttaacgaaccttaaaccgtttaacctaacgttacgtaaccaaacgtacgtaacctttaacggacccgggtacccctacgtttaccgtacccgtttacccgggtccctaaccggggtacccaccgtaacgtccctaacgtacctaccgaaccggtaacttggtcgacctggtaaccc

SEQ ID NO: 279844 - DNA, 790 bp, Homo sapiens
  misc_feature: GYAE6OF01BR99E.35.69.G03.1.454.CMB.1.raw
  modified_base (148)..(148): a, c, t, g, unknown or other
  misc_feature (148)..(148): n is a, c, g, or t
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
tcagtacagatcgtcacgaccggtgctcgatttagtcgctgcgtaaaggagaaagggggcaggagtcagtctcagtcaggacacagcatggacatgaggcctccccgctcagctccgtggggctcctgctactctggctccgaggtcnccagatgtagacatccagatcgacccagtcctccacgccctccctgtcctgcatcgtggcggagacaggactccaccatctacgttcggaccgggnaagtcagaccatcgcgtattaatttaagtgtactcgccaggacggcctaaggacgaacctacccctaactnacgtaatagtaactactacgttattacttaacgtttgacttaacgttacgttcggaccgttacccaagttaccggtaaacggtttccaaggttccggactaaagggttcggtaacttccgggtagggaaaccttaggttaccttttaaccctaccgttacgttaacccaacccgtttaacaaaccgtaaaactaattaacccggtaaactacccggttaagtaaacgtttccgtttaacgaactttaaaaccccgtttcgtaaccttaaccgttaaacccaaacgttaacggtaaaccccttttaaccgggaccccgggtttacccctttaaacgttaccgtttaaccccgggtttaccccggaaccggttaacccgggtaaaccctaaccggtaacccgttacccctaaaggttaacccctaaacccggtaaacgtttaacccggtggttacccgtaccggttacctaaacccc

SEQ ID NO: 279845 - DNA, 807 bp, Homo sapiens
  misc_feature: GYAE6OF01BY1XQ.35.69.G03.1.454.CMB.1.raw
  modified_base (147)..(147): a, c, t, g, unknown or other
  misc_feature (147)..(147): n is a, c, g, or t
  modified_base (154)..(154): a, c, t, g, unknown or other
  misc_feature (154)..(154): n is a, c, g, or t
tcagtacagatcgtcacgaccggtgctcgatttagtcgctgcgtaaaggagaaagggggcaggagtcagtctcagtcaggacacagcatggacatgaggcctccccgctcagctccgtgggctcctgctactctggctccgaggtcncagatgnacatccagagtcgacccagtcctcccacgccctcctgtacctcgactacttcgtcggtacggacgaacgagtacgtaccaacctattaccgacgttcgggacccgggtactaaacggtaccaaccggtaacccgttagtttccggtaaccgtttaactttaaaagtttttaaaaacgttcggggtactacccgggtaccaaaggggtaccggaacccgtaaagggggtaaccgaaaaccccgttaacccccccgttaaaaccgtttaaccggtaggtaaaacctttggtttaaacttaaccgtttagttaaccgttttaacctttaaacgttttcgactttaaagttacggtttaccggcccggtaaccctaagttacccggtaaaggtttccgaaggtcgggtactagggtagtaactcgggaggtactaagttctttacgacttacctacctactaactaacaaactaattaactaactaaccgttaagaacttaaccgttacgaaccttaaaccgttaactacgttacgtaactaaacgtaacgtaaccgttaaccgtaaccgacccgttaattccgttaccgttcccggtactaccgggactaacgtacgtacacgtaactaccgtaacgacgttgacgccttcggacc

SEQ ID NO: 279846 - DNA, 840 bp, Homo sapiens
  misc_feature: GYAE6OF01EEPB0.35.69.G03.1.454.CMB.1.raw
tcagtacagatcgtcacgaccggtgctcgatttagtcgctgcgtaaaggagaaaggggggcagggagtcagtctcagtcaggacacagcatggacatgaggcctccccgctcagctccgtggggctcctgctactctggctccggaggtcgccagatgtgacatccagatcgacccagtcctccacgtccctccctgtctgcattcgtggtcggagacaggacgtccaacctatctacgttcggaccgggacaagtccaacgacctacttccgacgttactttaatttaaagttggtactccgaccgaggacggaccgtaagggaacgaacccgtacccccttaaaccgtagtagtacttacggttaacttacgttagttacttaccttaacgttttcgaccttagttacgttccggaccgttaccctattacgtaaggttcgaggtcggacgtaggtacggtacgttacggtaggggtaacttaggttacctttttaccgaacctttcctaaccctaaacccttaaacttaacccaaaactttaaacttaaacccttaaacccgtaaaccgttaaggtaaacctttaccgttttaacgaacctttaaaccgtttaaccttaacgttaccggtaaacctaaaccggttaacgttaaacccgttaaccgggtaaccccgggttacccctttaacgtttaaccccgttacccgggtttaccccgggaaccccggtttaaccggggaaccccttaaaccgttaccggttaaccccttaacgttaacccgtaaccccgtaaaacggttaccgttaccgggttaccgtaccgtcccggtaaaccc

SEQ ID NO: 279847 - DNA, 714 bp, Homo sapiens
  misc_feature: GYAE6OF01BIEC2.35.69.G03.1.454.CMB.1.raw
  modified_base (205)..(205): a, c, t, g, unknown or other
  misc_feature (205)..(205): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatcgacccagtcctccagcctccctgtctgcatctgtacgganacgagacgtccaccatctacgttcggccggacaagtcagacctagttccgacgttacttaatttaaagttggtatccgtaccgaggacggaccgaagggaacgaaccgtacccccgttaaacctacgtagtaactggttaacttacgttgttaacttacctttacgtttagacctaattacgtacggtcccgtaccctaacgtaccgtaacgggttctaggtacggacgtaagggtggtacgtcggtagggacctaaggttactttaccacgttacctaccgtaaccctaacttaaccaaaactaaacttaactaacccgtaaaccttaggtaaacgttacctttacgaaccttaacgtttaactacgttactaaccaacgtaccgttaacgttaccggacccggtaccctaacgttccgttaccgttacccgggaccctacgggtaaccctacgtacgtaccaacgttaccgtaacctaaacggttacgttaggcgtcgtacgaaccc

SEQ ID NO: 279848 - DNA, 712 bp, Homo sapiens
  misc_feature: GYAE6OF01CCCON.35.69.G03.1.454.CMB.1.raw
  modified_base (371)..(371): a, c, t, g, unknown or other
  misc_feature (371)..(371): n is a, c, g, or t
tcagtacagatcgtcacgaccggtgctcgatttagtcgctgcgtaaaggagaaagggggcaggagtcagtctcagtcaggacacagcatggacatgaggctccccgctcagctccgtggggctcctgctactctggctccgaggtgccagatgtgacatccagctgacccagtcctccctccaccctgtctgcatctgtaggagaaacgctcaccatcacttcgccgacagtcagtagtattagtagttggtgctggtatcagacaagaaaccgaagggaaacgacccctaaactccgtagtacttacgtttacggcgttacttacgtttagaggtaggtcgggtaccagtacgtaacggttcgaggcggngtaggtgacgtcgtaggaactacgtacttcactcctaccacctactaccaccacgtcctagaccgtacgtcctagtacttagttacttttacgaaccctttaaaccttacgttaacctacggtaaccctaaacggtaacgtttagtacgggttaccgttaccgttttacccggttaccgtttaacccgggtttccccggaacccggtttaacggggaaacccgtaaagggtttacgggtaaaacttaacccggtaaaaccgtaaaaccgggttacggtttaccgggtacgttcccgttaccgtacccgtaaaccttcgtttaccgttcccggtttaacccg

SEQ ID NO: 279849 - DNA, 734 bp, Homo sapiens
  misc_feature: GYAE6OF01BHT0J.35.69.G03.1.454.CMB.1.raw
  modified_base (233)..(233): a, c, t, g, unknown or other
  misc_feature (233)..(233): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatcgacccagtcctccagcctccctgtctgcatctggtacggagacagactcacatcacgttcggccgganaagtcaacgacctagttcgacgttacttaattttaaacgttggtaactccggaccgaaggacggacccgaagggaacgaaccgtcccccttaaactacgtagaacttagtaacttacgttagttacttaccttactttgactaattacgttcgtaccggtacccagttacgtaaggtttaccaggttcggacgtaggttggtacttacggtacgggtaactagttactttaccaaccttccaactaacccgtaactaacctaaacctaaactttaaccgtaacctaaacccgttaggtaaacgttttaacctttcgtaaaccctttaaaaccgtttacgtaaccctttaacgaactaaaccgtaacgttaacccgttaaccggacccggtacccctttaacgttccgttaacccggttttcccggacccggttaccggaaaccttacctacggtaccctacttaacccgaccgtaaaccgtacgttggtacgctccgtacc

SEQ ID NO: 279850 - DNA, 644 bp, Homo sapiens
  misc_feature: GYAE6OF01CSVVJ.35.69.G03.1.454.CMB.1.raw
  modified_base (340)..(340): a, c, t, g, unknown or other
  misc_feature (340)..(340): n is a, c, g, or t
  modified_base (519)..(519): a, c, t, g, unknown or other
  misc_feature (519)..(519): n is a, c, g, or t
  modified_base (637)..(637): a, c, t, g, unknown or other
  misc_feature (637)..(637): n is a, c, g, or t
tcagtacagatcgtcacgaccggtgctcgatttagtcgctgcgtaaaggagaaagggggcaggagtcagtctcagtcaggacacagcatggacatgaggcctccccgctcagctccgtgggctcctgctactctggctccgaggtcgccagatgtgacatccagatcgacccagtcctccagtccctcctgtctgcactcgtgtacggagacagagtccaccatcacgttcggccggactagtcaagtacctagttccgcgttacttaattttaaagtggttactccgaccaggacggtaccgaaggaccgaaaccgtccccttaaactcgtagacgttntatacttgtacttacgttacgtttagctacttagttcgacccgttacacgttacgaaggttcgagttcgactaggtcgactcggaggactagttaccttcacctttacgacctaaccgtataccgaaactacgtaacaaccgtacgtaatacgtacttacgactttaactactaccgtnaaccgtaacgtacgtaaccgttaaccgaccggtaccctatttacccgtacgttccccggtaccgtacggacccagttaccgtcttaacggtacctaccgaacgttatccggtcgtccncggtacc

SEQ ID NO: 279851 - DNA, 774 bp, Homo sapiens
  misc_feature: GYAE6OF01DQZYW.35.69.G03.1.454.CMB.1.raw
  modified_base (217)..(217): a, c, t, g, unknown or other
  misc_feature (217)..(217): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactcgtggctccgaggtgccagatgcgacatccagatcgacccagtcctccacgccctcctgtctgcatctgcggagacagatccaccntcactcggaccggcaacgtcagacctattcgtcgttacttaatttaagtgtactcgacaggacggaccgtaggacgaaccgtacccccttaactacgtagtaatgttaactacttagtacttcttaactttcgacttaacttacgttccggtaccgtaccctacgttacgtaaaggtttcgtaggtcggtacgtaggttaggtacgtttccggtaaggggtaaccttaacgttaccttttaccgaaccctttaccctaaccttacccgaaacttaacctaaaaccgtaaactttaacgttaaacccttaaaccgttaacgtaaccggtttaactttaccggaaacccttttaaacctttaaccgtttaaaccgttaactaacccgtaaacgttaaccggttaaacccgtttacccggtaaccccgggttacccttaccgtttaccccggtttaccggtttaccccggtacccggtaaccggggtaccctaaccggtacccgttcctaacccttaacctaaccgtaaccgtacgtcgggtaccgtcgtaccgtaaccc

SEQ ID NO: 279852 - DNA, 570 bp, Homo sapiens
  misc_feature: GYAE6OF01EF387.35.69.G03.1.454.CMB.1.raw
  modified_base (232)..(232): a, c, t, g, unknown or other
  misc_feature (232)..(232): n is a, c, g, or t
  modified_base (328)..(328): a, c, t, g, unknown or other
  misc_feature (328)..(328): n is a, c, g, or t
  modified_base (436)..(436): a, c, t, g, unknown or other
  misc_feature (436)..(436): n is a, c, g, or t
tcagtacagatcgtcacgaccggtgctcgatttagtcgctgcgtaaaggagaaagggggcaggagtcagtctcagtcaggacacagcatggacatgaggcctccccgctcagctcctgggctcctgctactctggctccgaggtgccagatgtgacatccagatcgacccagtctccagccctccctgtctgcatctggtcggagacagagtcaccatcacgtcgccggganaagtcagaccattcgcgtacttaatttaaattggtactcgacagacggcaggacgaacgcccctaaactacgtgatgtattactgtatcttatttnatattactcggccgtaccagtcaaggtttcaggtgacgagtggactgtaggactagttactttcactctcacatacaactaataactactaactagtaactactttanaccttaacttactacgtataacaacgtacgtaacctacgacggtacccctattacccgtcgttccggacccgttacggacctacgacgtcccaagttaccacccgtaaacgtacgttggacgtccgtgaacccc

SEQ ID NO: 279853 - DNA, 628 bp, Homo sapiens
  misc_feature: GYAE6OF01E3ZYX.35.69.G03.1.454.CMB.1.raw
  modified_base (211)..(211): a, c, t, g, unknown or other
  misc_feature (211)..(211): n is a, c, g, or t
  modified_base (621)..(621): a, c, t, g, unknown or other
  misc_feature (621)..(621): n is a, c, g, or t
tcagtacagatcgtcacgaccggtgctcgatttagtcgctgcgtaaaaggagaaagggggcaggagtcagtctcagtcaggacacagcatggacatgaggcctccccgctcagctccgtggggctccctgctactctggctccgaggtgccagatgtgacatccagatcgacccagtctccacgtccctccctgtctgctatctgtcgganacagacgtcaccatccacgttcggccgggcaagtcacgacctagttccgcttacttaatttaaagttggtactccgacctaggacgccgaggtacgaacctaccccctaaactctagattgtaacttacgtgtacttaccttagtttcgactagttacgttcgcccggtaccctatacggtaacggttcaggtacgtcgaaggtcggacttcggtagggaactagtactttccacgttacctacaccctaataaccgaaactaaacgtacctaacgtaacctagtaaacgttaccttacgtaaccctaaccttaactacgtaatacccaagtacgttactaaccgcggtaccctatcctacgttccgccgtacggacccagacttcactaccaaccgtaacgtactggcncgtcaac

SEQ ID NO: 279854 - DNA, 818 bp, Homo sapiens
  misc_feature: GYAE6OF01CWPSQ.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctccgtggggctcctgctactcgtgctccggaggtgccagatgtgaacatccagatacgaccctagtcctccacgccctccctgtctcactactcgtggtacggacgaccagacgtaccacctactccgtaacgttcggcccgggacgtacgtacgactaccctacgtttaccgtcgtttactttaaatttttaaacgttacggttacgtaccgtacgaacggacgggaccgaagggaaccgaaccgtaccccctaaccgttactaggtaacgttagtaacttacgttagttaactttcttaacgttctacgtattacgttaccggaccgttacccgtacgtttaacggtaaccggtttaggacggttacggtcgtagggtacggtacgtcggtaaccgggtcgttaaacgttaccgtttcctaacccttactaaccgttaacccctaataaacctaaaaccttacttaaaccgtaacctaacccgttaaaggtacgttaccgtttaacgtaccccgtttaaattaccctttaacgtacctaaaccgtaaccgtttagtaaacccggttacccgaacccggttacccttaacttaccccggttaacgttccccgggtaccggaaccccgtacgttaccctaaccggttacaaacccgttaagtaccccgttaaaagacccgtttggaaaccgtccgagttaaccccc

SEQ ID NO: 279855 - DNA, 784 bp, Homo sapiens
  misc_feature: GYAE6OF01AKJAB.35.69.G03.1.454.CMB.1.raw
tcagtacagatcgtcacgaccggtgctcgatttagtcgctgcgtaaaggagaaaggggggcaggagtcagtctcagtcaggacacagcatggacatgaggctccccgctcagctcctggggctcctgctactctggctccgaggtgccagatgtgacatccagatgacccagtctccagccctcctgtctgcatcgtggtacggagacagacgtccaaccgatccacgttcggacccggggacaaacgtccaacgaaccctacgtttccggacgttaccttaaagtttttaaaagttcggtaactccggaccaagggtacggaccccgaaggggtaaccggaaacccgtacccccttaaaaccgttcgtaggaaacttggttaaacttaacgttgtaacttcctttaaccgtttggacttaagttacgtttcggacccgttacccagttaccgtaagggtttccaaggtttcgaccgtagggttacggactttcggaggggaactagtttaacctttacccgaaccttccttaccgtaaacccctaattaacccgtaaaacttaaccgttaaccttaaccgtaaaccttaggaaaccgttacctttacgaacctttaaaccgttactaactacgttaaccgaaactaacgtaaccttaccggaaccggttacccctagttaccttacccgttacccgggtaccctacgggtaaccctacggtaccgtaccctaagtaacccgtaaccctaaacgggtaaccttcggtacgaccgttccgaaccc

SEQ ID NO: 279856 - DNA, 677 bp, Homo sapiens
  misc_feature: GYAE6OF01BMUOJ.35.69.G03.1.454.CMB.1.raw
  modified_base (670)..(670): a, c, t, g, unknown or other
  misc_feature (670)..(670): n is a, c, g, or t
tcagtacagatcgtcacgaccggtgctcgatttagtcgctgcgtaaaggagaaagggggcaggagtcagtctcagtcaggacacagcatggacatgaggcctccccgctcagctccgtggggctcctgctactctggcctccgaggtcgccagatgtgactactccagatcgaccctagtcctaccgacgtccctccctgtctcgactactctggtacggagtacgagtacgtacacctactcctacgttcgggaccgggactaacgtccgaacgtaccctagttccgtacgttaactttaaagttttaaacgttcggtaactccgaccgtaggacggaccgtaaggaacgtaacccgtaccccttaacgtacgttacgtacttagtaacttacgttagttaccttacttacttcgactattacggtcgtaccgtacctagtacgtaacggttcgacggtcgtacgtaggtaggtactcggtaggtaactacgttcttaccacgttcctacactaactaacaaactaattacctaacgtaactagtaactattacgaacttactacgtactacgtactaacgtaccgtacgtacgtcccgtacctacttccgtaccggttccgaccgtacgcctacgtacgtacacgtacctaacgtactcggtagtcgntccgaac

SEQ ID NO: 279857 - DNA, 766 bp, Homo sapiens
  misc_feature: GYAE6OF01A7I50.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctcccgctcagctccgtgggctcctgctactcgtgctccgaggtgccagtatgtagactatccagactcgaccctagtcctaccacgtccctcccgtgtctgactacttcgtggtacggacaacgagtacgtaccacgtactacctacgttccggaccgggaactaacgtaccgaacggtacccttacgtttccggtacgtttaactttaaaagttttaaacggttggttaaccgtccgacccggaaggaccgggacctaacggggaaaccgtaaaccccgttaaccccgttaaaccgttagtacgtaagtttacgttaaccttaagttacgttaactttacccgttatttcggacttaagtttcgtaccggtcctaactagtacgtaaggttcaggtcgactgggtagtagtcggacgtattacgtcttacctacctactacctaactactaaactaaactaacgttaactaaccctaacgtacgtaactttaagttaccaacctttaaccgttaactacgtaactaacgtaacgtaaccgttaaccgtacggtacccgtaccgttaacgttacccgttaccgggtacccgtaccgttaaccggactaaccgtctaacgtaaccttaccgaacgtaaaccgttcgtaggtaccggcctcgtacccg

SEQ ID NO: 279858 - DNA, 603 bp, Homo sapiens
  misc_feature: GYAE6OF01EUIHP.35.69.G03.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
  modified_base (484)..(484): a, c, t, g, unknown or other
  misc_feature (484)..(484): n is a, c, g, or t
  modified_base (592)..(592): a, c, t, g, unknown or other
  misc_feature (592)..(592): n is a, c, g, or t
tcagtacagatcgtcacgaccggtgctcgatttagtcgctgcgtaaaggagaaagggggcaggagtcagtctcagtcaggacacagcatggacatgaggctccccgctcagctccgtggggctcctgctactctggctccgaggtgccagatgtgacatccagatcgacccagtctccagcctcctgtctgcatcngtcgagacagacgtcacctntcctacgttggccggactaaggttcacgacctagttccggacgttacttaagtttaaatggtactcgacgagacggacaggaacaaccgtccctaacgtatgtattacgattactgttaactcttacgttnactagtacgtcgccgtacctagcgtaaggtcagcgacaggtnacgtgttaaggactagtacgttcactctaccataacactaactaactactaacgaacctaggtaaactcgttaatacccttaagttacacgttanaaacctagtaacgttaacctaccggaccgttaccttatacccgttccgttccggaaacccgttggaaccctacgaagttcccataaccgtacgaacctagtccggacncggtacctacg

SEQ ID NO: 279859 - DNA, 700 bp, Homo sapiens
  misc_feature: GYAE6OF01DUBX8.35.69.G03.1.454.CMB.1.raw
  modified_base (195)..(195): a, c, t, g, unknown or other
  misc_feature (195)..(195): n is a, c, g, or t
  modified_base (692)..(692): a, c, t, g, unknown or other
  misc_feature (692)..(692): n is a, c, g, or t
tcagtacagatcgtcacgaccggtgctcgatttagtcgctgcgtaaaggagaaagggggcaggagtcagtctcagtcaggacacagcatggacatgaggctcccgctcagctcctgggctcctgctactctggctccgaggtgccagtatgtgacatccgagactcgacccagtcctccacgtccctccctgtcncgccattctggacggacgacgagtacgtccaccattccacgttcggaccgggtacaaggttccaacgacctacgtttccgacgtttacttaaagttttaaggtcggttactccgtaccgaggacggacgtaaaggacgaaccgtacccctaacgtactgacttagtacttacgttagttacttaccttaacgttcgtactaacgttttacgttccggtaccggtcccctaaagtcgttaaacggtttccgtaagggtccgacgttacgggtacgttaccggtttcgacggggttaactacgtttactttaccgtacctttaccgacctaactaactaactaaacaattacgtaacctacgttacgtaacgttaccgttaactacctaacttacgtacttacacctaacgtcgaacttaccggaccgtaccctacgttacgtaccttccgcctcggtaaccacgtactcgtaaactccgtaacgtacgtacgtagcgntccggacc

SEQ ID NO: 279860 - DNA, 763 bp, Homo sapiens
  misc_feature: GYAE6OF01AJLWX.35.69.G03.1.454.CMB.1.raw
  modified_base (111)..(111): a, c, t, g, unknown or other
  misc_feature (111)..(111): n is a, c, g, or t
  modified_base (529)..(529): a, c, t, g, unknown or other
  misc_feature (529)..(529): n is a, c, g, or t
  modified_base (727)..(727): a, c, t, g, unknown or other
  misc_feature (727)..(727): n is a, c, g, or t
tcagtacagatcgtcacgaccggtgctcgatttagtcgctgcgtaaaggagaaagggggcgaggagtcagtctcagtcaggacacagcatggacatgaggctcccgctcanctcctgggctcctgctactctggctccgaggtgccagatgtggacatccagatcgaccagtctaccgcgtccctccctgtcgtgacctatcgttggacggagtaccgacgtcgtaccaccacttaccgacgttccgggaccggtacgtaacgtcgaggacgaccttaggttacggtacttaacggtttactttaaaggttacggtaactaaccggaaacggtaaaccggaacgggtaaacccgtaacccttaaactccgtaaggtacttacgtaacgtcggtacctacggtactacgtttacctaacggtttaacgacggttaacgggggtaccggtaccgtacgtacggtactgggacgtacggtagtacggtaagtccggtaggtaactaacgttacgtaccgtacctacgtaacncctagtacgcgtactacgtcgtacgtacgtacgtataaccgttattacggactacgttactagtaccgtaagtaccgtaagtacccgaacgtttaaccgccgggaccttacgaccgttacggtaccgtaacccgggtaccgtaaccggggtaaccgtaacggtaaccgttaacggttaaacggtaaccggtttaaaanaaacccggggtttacgtacgtaggtcccctaacggg

SEQ ID NO: 279861 - DNA, 507 bp, Homo sapiens
  misc_feature: GYAE6OF02GQNBT.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaattggtatcgccagaggccaggagaacgcccctaactactgatgtatactgtatctactttgcatattgcgtccatcaaggttcagtgcagtggatctgggacagtatttcactctcaccatacaacaatatacaacctgaagtactttgactaactttactactgtacaacagtaccttacgacggcccattccacctttccggccctgggaacccactacgtccatactaccaacgtactggtcggctgacc

SEQ ID NO: 279862 - DNA, 507 bp, Homo sapiens
  misc_feature: GYAE6OF02G1B7Q.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccaggagaagcccctaactactgatgtatactgtatctactttgcatattgcgtccatcaaggttcagtgcagtggatcgtgggacagatttcactctcacatcaacaatatacaacctgaagtactttagactaacttactacttacgtacaaacagtaacttacgacgggtaccccattccactttccgcccgtggacccacacgtccatactaccaacgtactgtacggctgacc

SEQ ID NO: 279863 - DNA, 546 bp, Homo sapiens
  misc_feature: GYAE6OF02IWEST.35.69.G03.1.454.CMB.1.raw
  modified_base (227)..(227): a, c, t, g, unknown or other
  misc_feature (227)..(227): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggnaagtcagaccattcgcgtctatttaaatggtatcgccaggagccaggagaacgcccctaacctactgatgtatactgtatctactttgcattattgcggtcccatacaaggttcagtgcaggtgatctgggactagtatttcacttctacacctatacaaacaatactaacaaacctgaaacgtactttgacctaaacttactaacttagtaccaaactacgtaacttaacgacggtcccctaattcctacgtttccggccccttgggaaccctaacacgtacccaagttactaccaacgtaacctggtacgctagacc

SEQ ID NO: 279864 - DNA, 603 bp, Homo sapiens
  misc_feature: GYAE6OF02H19N3.35.69.G03.1.454.CMB.1.raw
  modified_base (205)..(205): a, c, t, g, unknown or other
  misc_feature (205)..(205): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgaccccagtcctccacgcctccctgtctgcatctgtcgganacagacgtcacatcacttcggccgggacaagtcacgacctattccgcgttacttaatttaaagttggtactccgaccaggacggaccaagggacaaccgtacccctaaactctagatagtactactgtatcttattgcttaatagtcgccgtaccagtaccgtaaggttcaggtcggactaggtggtactcgtaggggactagtactttacacttctaccaacctataacaaactaactaactaacctaactagtaacgttactttacgaactaaaccttactaactacgtaccaaactacgtaacttacgaccggtaccctaagttaccctacgttcccggaccgttacggacctacactacctaatacctacaacgtacgtggtacgcgtacgacc

SEQ ID NO: 279865 - DNA, 529 bp, Homo sapiens
  misc_feature: GYAE6OF02G3HF7.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccaggacgaacgcccctaaacctactgatgtatactgtactctaactttgctatattgcggtccatcaaggttcagtgcagtgatctagggacagtattcactctcaccatcaaacaatactacaacctgaacgtacctttagcctaacttactactacgtacaacagtacttaacgacgggcccctattcctacgtttccgcccgtagggacccacgtagtccctaagtactaccaacgtaactcggtacgtctgaccc

SEQ ID NO: 279866 - DNA, 517 bp, Homo sapiens
  misc_feature: GYAE6OF02JCRK3.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaattggtatcgccagaggccaggagaacgcccctaaactactgatgtatactgtatctactttgcatattgcgtccatcaagttcagtgctagtgatcgtgggacagtatttcactctcaccatacaacaatactacaacctgaacgtactttgactaacttactactatacaacagtacttacacggtccctattcctacttcgaccgttcgggaacctacgacgtaccattacctaccgaacgtaacgtgtacggtctcgacc

SEQ ID NO: 279867 - DNA, 639 bp, Homo sapiens
  misc_feature: GYAE6OF02IZI6L.35.69.G03.1.454.CMB.1.raw
  modified_base (205)..(205): a, c, t, g, unknown or other
  misc_feature (205)..(205): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtcctgcatcgtgtcgganacagagtcaccatccacttcggaccggacaagtcaacgacctagttcgcgttacttaattttaaagttcgggtattccggaccaggaacggcccgaagggaacgaaaccgtccccccttaaactacgtagacgttacgtaacttaacttagttacttacgttactttgaacttaattacgtttcgaccggttacccaagttacgtaacggtttacaggttcgacgtaaggtcgtatcggtaggactagtactttcacgtctacactatacaactataactacaactagaatcttactactaacttactactatacctaacgtacgtaacgttaccaccggtaccctacttaccgtaccgtttccggaccctacgggacctaaccgtacgttaccaacttaacgtaccaacgtacctggtacgtaccagtaaccc

SEQ ID NO: 279868 - DNA, 517 bp, Homo sapiens
  misc_feature: GYAE6OF02FMR85.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagagccaggagaagcccctaactactgatgtatactgtatctactttgctatattgcgtccatcaaggttcagtgcagtggatcgtggacagtatttcactctcacatacaaacaatactaacaactagaagtactttgactaacttactactagttacaactagtaccttacgacggccctattccacttttccggccctagggaacccactacgtacctaatactaccaacgtactggtacggtctagacc

SEQ ID NO: 279869 - DNA, 558 bp, Homo sapiens
  misc_feature: GYAE6OF02H4BV8.35.69.G03.1.454.CMB.1.raw
  modified_base (107)..(107): a, c, t, g, unknown or other
  misc_feature (107)..(107): n is a, c, g, or t
tcagtacagatcgtcacgaccggtgctcgatttagtcgctgcgtaaaggagaaagggggcaggagtcagtctcagtcaggacacagcatggacatgaggctccccgntcagctcctggggctcctgctactctggctccgaggtgccagatgtgacatccagatgacccagtctccagcctccctgtctgcatctgtcggagacagagtcaccatcacttgccggcaagtcagaccattcgcgtctatttaaatggtatcgcagaggccaggagaacgcccctaactactgatgtatactgtatctactttgctatattgcgtccatcaagttcagtgcagtggatcgtgggacagtactttcactctcaccatacaaacaatactaacaacctagaagtacctttagacctaaactttactaacttacgtacaaacgtacgtaaccttaacgacgggtacccctagttccgtaaccgttttccggcccgtacgggaaccctacgtacggttacctaactacgtaccaacgtaaccgttcggtacgacctggtaaccc

SEQ ID NO: 279870 - DNA, 716 bp, Homo sapiens
  misc_feature: GYAE6OF02FFNXM.35.69.G03.1.454.CMB.1.raw
  modified_base (107)..(107): a, c, t, g, unknown or other
  misc_feature (107)..(107): n is a, c, g, or t
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
tcagtacagatcgtcacgaccggtgctcgatttagtcgctgcgtaaaggagaaagggggcaggagtcagtctcagtcaggacacagcatggacatgaggctccccgntcagctccgtgggctcctgctactctggctccgaggtgccagatgtgacatccagactcgaacccngtcctaccagtccctcctgtctgctatcgtgtcgganacaggtactccaacctntccgtacgttcggacccggactaacgtcaacgacctacgttcggtaccttattaattttaaacgtcggtaactccggaccgaggaccgaccggaaggtaaccgtaaccctaccccttaaacgtacgtagtacttacggttactacgttagttacttactttaacgtgacttagttacgttcggacccgtactacgttacgtaacggttcgtaggtcgtacgtacggtagtacgttcggacgtactacgtttactccgtactaccaacacgtaaactaactaaacggtaactacgttaaccgaactacgttaacgttacctacgttaaacctttaaccgttactaccgaacttaaccgaaaccgtttaccggtaacccgttaacccgggcccttaacccttacgttccccgtaccggttcccgaccgtacgtaacccacgtacctaacctactaccgaccgtaacgtccggtcgtaccgtcttaccgacc

SEQ ID NO: 279871 - DNA, 612 bp, Homo sapiens
  misc_feature: GYAE6OF02H40V5.35.69.G03.1.454.CMB.1.raw
  modified_base (229)..(229): a, c, t, g, unknown or other
  misc_feature (229)..(229): n is a, c, g, or t
  modified_base (290)..(290): a, c, t, g, unknown or other
  misc_feature (290)..(290): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttcggccgganaagtcagtaccgttcgcgttcttaatttaaattggtatcagacaagaaaccgagggaaccnccctcagctgctgctctatactgttactcttagtttccagttcgttcgggtccctagtacgtaaggttcgaggttcggcgtaggttcgggtttcgtaggggtactagtacttttccgacttacctactacttatacgagtcctacgtcgtcgacctaacgttagaagtagttacgttcgtacttaacttacttacttgtaaccaactacgtaaccttaccgacggtacccctagttacccgttacgttccgacccgttcggaacctacgtaaccgtacgaaccgttccgacgacgtacgtagtcggtactcgtacctaaccg

SEQ ID NO: 279872 - DNA, 562 bp, Homo sapiens
  misc_feature: GYAE6OF02I025A.35.69.G03.1.454.CMB.1.raw
  modified_base (228)..(228): a, c, t, g, unknown or other
  misc_feature (228)..(228): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatccacttgccgggnaagtcagaccattcgcgtctatttaaattggtatcgccagaggccaggagaacgcccctaacctactgatgtatactgtatctactttgcatattgcgtcccatcagttcagtgcagtggatcgtgggacagtatttcactctacacctatacaaactaatactaaccaactagaactacttagactaacttactaactgtacaacagtacttaaccgacggtacccctaattacctaccgtttaccggacccgtacgggtaaccctaaccgtacgtaccctaattaccgtaacccgtaaaccggtaacttaccggtacggtaccttagaaccc

SEQ ID NO: 279873 - DNA, 504 bp, Homo sapiens
  misc_feature: GYAE6OF02G7DDO.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagagcattggcagttctttaaattggtatcaacggaaaaccagggaaaagcccctaaaactcctagatctaatgctgcatccattttgcaaagtgggtcccggcaaaggttcaagtggcagtggatctgggacagaattcactctacaccatcagcagtctgcaacctgaagattttgcaactactattgtcaacagattacaagttacgcccgcgaatcagcttcggcctaaagggacacgactggagaattaaaagaactgttaggctag

SEQ ID NO: 279874 - DNA, 584 bp, Homo sapiens
  misc_feature: GYAE6OF02G5EB0.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtctgcatctgtcggagacagagtcaccatcacttggccgggcaagtcagaccattcgcgttacttaattttaaagttggtatcgccaggacggccaagggacgaacgccccctaaacctactgatgtatactgtatctatttgctatattgcgtccatcaagttcagtgcaggtgatcgtagggacagtactttcacttctaccacctatacaaactaatactaacaaccgtagaacgttacttagaacctaactttaactacgttacgtactaaacgtacgtaacttacgaccgggtacccctaattccgtaccgtttccggacccttaggggaaccctaaccgtacgtaccctaattacctacccgtaacgtaaccgttggtacggctacgaccc

SEQ ID NO: 279875 - DNA, 602 bp, Homo sapiens
  misc_feature: GYAE6OF02HMEX5.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtcctccagccctccctgtctgcatctgtcggagacagagtccaccatcacttcggccggacaagtccagacccattcgacgttacttaattttaaattggtactcgaccaaggacggaccaagggaagaaccgaccccctaaacctactagatagtaatactgtactcttactttgctattacttcgccgtaccatacgtaagttcagtgcagtgatcgtgggaatagtactttcacttcacaaccatacaaactaataactaaccaacgttagaacttctttagaccttaaacttactactacgtacaactagtaccttaacgaccggtacccctaattcccgtaactttcccgggacccttacggggaacccacttacgtacctaacttacctaacccgaacgtaaccgttgggtacgccttcgaaccc

SEQ ID NO: 279876 - DNA, 576 bp, Homo sapiens
  misc_feature: GYAE6OF02HC4YE.35.69.G03.1.454.CMB.1.raw
  modified_base (203)..(203): a, c, t, g, unknown or other
  misc_feature (203)..(203): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtctgcatctgtcgganacagagtcaccatcacttgccgggcaagtcagaccattcgcgtacttaatttaaattggtactcgccaggagccaggagaacgcccctaactactgatgtatactgtatctatttgactatattgccgtaccatcaaggttcagtgctagtggattcgagggacagtacttcactctccacctatacaaataataactactaaacctgaaatacttagacctaacttacttacctagtaccaactacgtaaccttaccgaccgggtacccctagttaccgtccgtttaccgggcccgtacgggtaaccctaccgtaacggtcccaacgttaactacccgtaaaccgtacgttacggtcggtacgttaccgacc

SEQ ID NO: 279877 - DNA, 786 bp, Homo sapiens
  misc_feature: GYAE6OF02JKA73.35.69.G03.1.454.CMB.1.raw
tcagtacagatcgtcacgaccggtgctcgatttagtcgctgcgtaaaggagaaagggggcaggagtcagtctcagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttcgcccggaccagtcagagtattagtaattggtggccttggtatcgagcaagaaaccgagggaaacgacccctaaactcctagactttacgttaaggccttacttaccgttttaacggaaggtacgggttaccggggttacccctaagttaccgtaaagggtttccgaaggtcccgggtacgtaagggttcgggtaacgtttccggtacgggggtaacctaacgggttccgttttaaccgaccttacccgttaccaaccgtaaccttacccgaacccgaacggtccccgtacggtacccgtaccggtaccttacggtaacttacggtaacgtttttacggaaccgtttaaaccctttaacgtttaaccgttacgtaacccctaacgtaacggttaagttacgggttacgttaccgtttacccgttaccgttacccgttttaccggtacccggttacgggtaacccgtaaacggtaggttaacgtaacttaaccgtaaacggttaacgttcgggtaccgtacgtaccgtaccgtaaccgttacttaccggttacgttcccgttaaccg

SEQ ID NO: 279878 - DNA, 949 bp, Homo sapiens
  misc_feature: GYAE6OF02GIVJA.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtctgcatctgtcggagacagagtccaaccatccacgttggcccgggacaagtccaacgacctattccgcgtacttaaagttttaaatggtattccgaccaaggacggacccgtaagggaacgtaaaccggaccccccttaaaccgtacgtacgtacttacgttaagttaacctttaggtaactttccgtttaacgttttcgactaagttagtttccggacccggttaccctaagtttccgtaaaacgggtttcaagggttcgggtaccgtaagggttcggtaacgttccgggtaagggggaaccttaaagggtttaccttttacccgtaaacccgtttccttaacccgtaaccccgttaaaattaacccgtaaaaaaaccttaaaccgtttaaaaccctttaaaccccgtaaaacccggtttaagggttaaaaaacccgttttacccgtttttaaacgaaacccctttttaaaaccccgttttaaaccggttttaaacccgtaccgttttaaaccccgaaaaaccgttaaacggtttaaaaccccgttttaacccgggtaaaccccgggggttaacccccccttaacgttttttaaccccgttaaccccgggtttttttacccccccgggggaaccccgtttacccggggggtaaaacccccttaccgggttaaacccgttaccccgttaacgtttaaacccgtaacccgtaaaccgggttaacccgtttacgggtaccgggttaccctaccggtaaccccg

SEQ ID NO: 279879 - DNA, 568 bp, Homo sapiens
  misc_feature: GYAE6OF02JSUPP.35.69.G03.1.454.CMB.1.raw
  modified_base (202)..(202): a, c, t, g, unknown or other
  misc_feature (202)..(202): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcgganacagagtcaccatcacttcgccgggcaacgtcagaccattcgcgtacttaatttaaattggtatcgccaggaggccaggagaaccgcccctaacctactgaactgtactactcgtaattcttactttgactagtagttcgccggtccatcgaaggttcaggtgctaggtggactcgtgggactagtactttcacttctcaactatacaaacataactactaactagaatacttagactaacttactactacactaaacagttaacctacgtaccggacccctattaccttacgttcccggacccgtacgggaaccctacgtacctacgaactacctaaccgtaacggtacctaggtcgactgtacc

SEQ ID NO: 279880 - DNA, 553 bp, Homo sapiens
  misc_feature: GYAE6OF02GH69Z.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccaggagaacgcccctaactactgatgtatactgtatctacttgcatatgcgtccatcaagttcagtgcagtggatcgtggacagtatttcactctacaccatacaaactaatactaacaactgaactactttgactaacttactactgtaccaaactacgtacttaacgaccgggtacccctagttaccctaccgttttccggacccgttacgggaaccctacgtacgttaccctaacttacgtaaccccaacggtaaccgttcggtacggtacctgtaaccc

SEQ ID NO: 279881 - DNA, 576 bp, Homo sapiens
  misc_feature: GYAE6OF02FYN44.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtcttaatttaaatggtatcgcagaggccaggacaacgcccctaactactgatgtatactgtatcttacttgctattattgccggtaccatacgtaaggttcaggtcggctaggtggattcgtagggacagtactttcacttctcacatacaaactaatactaaccaactagtaacgtactttagaccttaaacttactactacgtaccaaacgtaagtacctttacgaccggtcccctaattccctacctttccgggaccctacgggtaacccaccgtacgtacccaagttaacctaccgtaaaccgtaacgtcggtggtacctacgtaccc

SEQ ID NO: 279882 - DNA, 592 bp, Homo sapiens
  misc_feature: GYAE6OF02HHHGY.35.69.G03.1.454.CMB.1.raw
  modified_base (234)..(234): a, c, t, g, unknown or other
  misc_feature (234)..(234): n is a, c, g, or t
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatcgacccagtcctccagcctccctgtctgcatctgtcggagacagacgtccaccatcacttcggccggganaagtcagacctattcgcttacgttaattttaaagttggtaactccgaccgaaggacgggccaagggacgaaaccgtccccctaaaccgtactgtaactggttaataccgttgtaactacctttactttgactaattacgttggaccgtacccaagtcgtaaaggttcaggtcggactaggtgtatcgagggactagtntttccactctcacatacaaactatacacaactagaacgttattcgacttaacttactactactacaanactactacgacgtccctagtctaccgttcgccgtacggaactacacgtacctataccgtaaccgtacgtaaccgtcggtacgactcggtacc

SEQ ID NO: 279883 - DNA, 732 bp, Homo sapiens
  misc_feature: GYAE6OF02JA154.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtccaccatcacttggccgggcaagtcagacctattccgcgttacttaattttaaattggtatccggccaaggacggaccgaagggaacgaaaccgtccccccttaaaacctacgtagtacttaggttaattaccttagttacttacctttaacgttttcgacttaatttaacgtttcggcccggttaccccaattaccgtaaacggtttcaggttggaccgtaaggtgggtaactcggtaggggaacctaaggttactttttaccgacctttccgtacctaaccctaattaacccaaaactaaacttaaaccttaaacctaaacccgttaggaaacttacctttacgaaccttaaaccttttaacgtacttacgtaacctaaacgtaacgtaacctttaccggaaccggtaccccttaagtttcccttaaccggtttcccggacccgttaccggaaaccctaccgttacgtaccctaatttaacctaccccgtaaacgaccgttcggtacggccttacgacccc

SEQ ID NO: 279884 - DNA, 551 bp, Homo sapiens
  misc_feature: GYAE6OF02HWFRX.35.69.G03.1.454.CMB.1.raw
  modified_base (204)..(204): a, c, t, g, unknown or other
  misc_feature (204)..(204): n is a, c, g, or t
  modified_base (275)..(275): a, c, t, g, unknown or other
  misc_feature (275)..(275): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctccagccctccctgtctgcatctggtcgganacagatcaccatcacttgccggcaagtcagaccattcgcgtctaattaaattggtatcgcagagccagganaacgcccctaactatgatgtatactgtatctacttgactattatcgccgtccatcgaagttcagtgctaggtgatcgtaggacagtactttcactctacacatacaaacatactaccaacgtgaacttacttagacctaactttactacgtacgtacaacgtacgtaacttacgaaccggtccctaacttccgtaccgtttccgggaccctacgggaccctaacgtacgtaccaacgttactacccgaaacgtacgttggtcggtacctagacccg

SEQ ID NO: 279885 - DNA, 533 bp, Homo sapiens
  misc_feature: GYAE6OF02FI59C.35.69.G03.1.454.CMB.1.raw
  modified_base (277)..(277): a, c, t, g, unknown or other
  misc_feature (277)..(277): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgacccagtctcaagcctccctgtctgcatctgtcggagacagagtcaccatcacttgccgggcaagtcagaccattcgcgtctaattttaaatggtatcgccagagccagganaacgcccctaactctgatgtatctgtatctactttgctatattgcgtccatcaaggttcagtgcaggtgatcgtgggactagtatttcactctacaccatacaaactaatactaactaaccgtagaacgtactttagacctaactttactactagtaccaaacgtagtaaccttacgaccggtaccctattcctaccgtttccgcccgtagggaacccactacgtcctatactacccaacgtactgcggtctgacc

SEQ ID NO: 279886 - DNA, 734 bp, Homo sapiens
  misc_feature: GYAE6OF02JPISW.35.69.G03.1.454.CMB.1.raw
tcagtacagatcgtcacgaccggtgctcgatttagtcgctgcgtaaaggagaaagggggcaggagtcagtctcagtcaggacacagcatggacatgaggctccccgctcagctcctgggctcctgctactctggctccgaggtgccagatgtgacatccagatgacccagtctccagcctccctgtctgacatctgtcggagacagagtccaaccatcacgttcggccgggacaagtccaagacctattcgacgttacttaattttaaattggtactcgaccaggacggtccgaagggaacgaaccgtacccccttaaacgtactggaacttacggtaacttaacgttacgttaacttactttaactttggacttaagtttaagtttccggacccggtttaccctaagttaccggtaaggtttccgaaggttcggactaagggttcggactttacggtagggaacttacgttactttacccaacgtttccaaccgtaccaattacaaaacttaagttaacctaaccgaaccgtaagtaaacgttacctttacgaaccttaaacctttacgtaaccttacgtaacctaaacgtacttaaaccgtttaccgaacccggttacccctaagttttcccgaccgttttacccgacccggtacgggtaaacccacgtaccgttacccaaagttacccgtaacccgtaacggtaccgttacggtaccgtcttaccgaaccc

SEQ ID NO: 279887 - DNA, 762 bp, Homo sapiens
  misc_feature: GYAE6OF02JXB23.35.69.G03.1.454.CMB.1.raw
tcagtacagatcgtcacgaccggtgctcgatttagtcgctgcgtaaaggagaaagggggcaggagtcagtctcagtcaggacacagcatggacatgaggcctcccccgctcagcctccgtggggctcctgctactctggctccgaggtgccagatgtgacatccagactcgacccagtcctccacgccctccctgtcctgcctatccgtggtacggagacaggacgtccaacccactcctaccgttcggcccgggtacaacgtcagacgctagttcggacttacgttttaactttaaaggttggtaactaaccgaaaccggaaaccgtaagggaaaccctaccccgtaaacctccgtagtacttctacgtcgactcgactactccttagtttacgaacgtaacgggtccgggtacccgacgtaacggttacgtacggtacggtacgtacggtacggtacgtcggtaacgggtacctaggtacctttaccgtaccctccgtaacccgaacctagtacctaaaccggtcgttaaccgttaccgtaaccggtaccctaaacggttagttaaaccgggtttactttcccgaaaccgtttaaacccttagtttaacgttaccgtaacctaaacgtaacgttaaccgttaacgtaacccggtacccgtcccgtaagttacgtaccgtacgttccggtaacccgacgggtaaccgacgtaacgtacggtacggtaaactaacgtaaacgacggttcggacgccgtaacg

SEQ ID NO: 279888 - DNA, 659 bp, Homo sapiens
  misc_feature: GYAE6OF02GYOCT.35.69.G03.1.454.CMB.1.raw
  modified_base (237)..(237): a, c, t, g, unknown or other
  misc_feature (237)..(237): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatcgacccagtcctccacgccctccctgtctgctatctggtcggagacagagtccaccatcacgttcggccgganaacgtcagacctattccgcgttacttaatttaaagttggttaactccgaccgtaggacgggaccctaagggaacgtaacccgtacccccctaaacttacgtagtaacttagttaacttacgtagttacttccttacgtttgacctagttacgttcggtccgtacctagttacgtaacggttcaggtcgtctaaggttcggactcggtagggactagttactttacaccgttactaccgactaactacaaactaacgttaactaaaccgtaacgtataacgttacttactactaaccttacttacgtacgtaacaactacgtaaccgttacgaccggtacccttacgttccgtaccgttcccgaccgtacggaaccctacgtactacctagtaccgacctacgtacgtcgtacgtcaccgtac

SEQ ID NO: 279889 - DNA, 680 bp, Homo sapiens
  misc_feature: GYAE6OF02GGBG3.35.69.G03.1.454.CMB.1.raw
  modified_base (108)..(108): a, c, t, g, unknown or other
  misc_feature (108)..(108): n is a, c, g, or t
  modified_base (175)..(175): a, c, t, g, unknown or other
  misc_feature (175)..(175): n is a, c, g, or t
  modified_base (183)..(183): a, c, t, g, unknown or other
  misc_feature (183)..(183): n is a, c, g, or t
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
  modified_base (484)..(484): a, c, t, g, unknown or other
  misc_feature (484)..(484): n is a, c, g, or t
tcagtacagatcgtcacgaccggtgctcgatttagtcgctgcgtaaaggagaaagggggcaggagtcagtctcagtcaggacacagcatggacatgaggcctccccgntcagctccgtggggctcctgcctactctggctccggaggtgccagtatgtgacatccagatcgaccngtcctccngtccctcctggtctgcattcgtgtcgganacagacgtccacatctacgttggcccggtanaacgctagaccttagttcgcgttacttaattttaacgttggtactccggaccgtaaggtacggacccgaaagggtaccaaccggtacccccttaacgtacgttacgtaacgttacgtttaactacgttacgttactttaccgtttaacttcgtacttagttacgttccggtccggttacctaacgttacgttaaacggttctacgggtcgacgttagggacgtacggtttcacggggttanacgttacttctaccttccgtacctaacgtactaacaactaacgtaccttaactaaacgtagtaagttacttacaacgttaacttacgtactactaccgatactacgtaccgacgtacctgttactacgttccgccgtacgtaccaacgtaccgtactaacgtaccacgtaaccgtacgtcgttcgtacgtccgtac

SEQ ID NO: 279890 - DNA, 701 bp, Homo sapiens
  misc_feature: GYAE6OF02F44XS.35.69.G03.1.454.CMB.1.raw
  modified_base (388)..(388): a, c, t, g, unknown or other
  misc_feature (388)..(388): n is a, c, g, or t
tcagtacagatcgtcacgaccggtgctcgatttagtcgctgcgtaaaggagaaagggggcaggagtcagtctcagtcaggacacagcatggacatgaggctccccgctcagctcctggggctcctgctactctggctccgaggtgccagatgtgacatccagatgaccagtctccagcctccctgtctgcatcgtgtcggagacagtacgtcacctataccacgttcggccgggtacaagtcacgacctaagttcggcgttacttaacgttttaaaagttcggtaactccgacgtaacggtacggaccgaaggaaccggtaaccgaccccccgtaaaccgtacgtacgaattagtaactacgttacgttaacttccgtttacgtttanacttagttaagttcgtcccggtaccctatacggtaaaggtttccaaggtcggtaccgtaggtagggtaccgtcgggtacgggaacttaggtaacgttttccgaaccgttcctaccaaccgtaactaaccgtaaacctaaattaacccttaaactaaacccgttaggaaaccttcgtttaacgaacctttaacgttactagtacgtactaagacgtaacttaccgggactacccgttatacctacgttccgaccgtacggacctacacgttacccgataccgtacccgtaaacgtcctgtagtaccctagaccc

SEQ ID NO: 279891 - DNA, 603 bp, Homo sapiens
  misc_feature: GYAE6OF01DUAUB.9.43.D10.1.454.CMB.1.raw
  modified_base (291)..(291): a, c, t, g, unknown or other
  misc_feature (291)..(291): n is a, c, g, or t
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtgttatgactatgtctcctggtatcaacaacacccaggacaaacgccccaaactcttgatttangaggtcaggtaggacggccctcgacggggtccctgatcgcttctctggctccaagtctgaccaacgaccggccctcccgtcgacccgtctcgtcgggcctccgaggtctgaggatgaggtctagtatttattgttgactagtctactattacttcgacgtacgtaaggttaacggttacgggtttcgggacgggtaacgggaccaaggtccgtacgaccgtcgtacgtccgaacgacccgtaaggtccctcccggtcccccgtcggtaccaccgttcctcccgttaccccctacccttccgtccgtaaccgg

SEQ ID NO: 279892 - DNA, 700 bp, Homo sapiens
  misc_feature: GYAE6OF01DJ1J0.9.43.D10.1.454.CMB.1.raw
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcattggtggttatgactatgtctctggtatcaacaacaccaggacaaacgccccaaatcttagatttatgaggtcaggtaggacggccctcgacggggtcctgatcgcttctcgtcggctccaagtctacgccaacgacggccctccctgacccgtctccgtgggcctccgaggcgtggacggagtggaggcttagtaatttagtttagttcgactagtctctattacgttacgaacggtacgtaacggttaacgttacgggggtttttaccgggaccggggtaacgggtaacccgtaacggtaccgtacggtaacccggttacccgtacgggtacccgtaaccggtacccccggtaaacgggtcccggttacccggtccccccccggttacccgggttacccgttaaccccgtttccccgtttaccccgggttttacccccccggtcccccgtttccccgtcccgttaaacccgggg

SEQ ID NO: 279893 - DNA, 556 bp, Homo sapiens
  misc_feature: GYAE6OF01BMGMD.9.43.D10.1.454.CMB.1.raw
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtgttatgactatgtctcctggtatcaacaacacccaggcaaacgccccaaactcttgatttatgaggtcagtaggacgccctcgacggggtccctgatcgcttctctggctccgaagtctcgaccaacacggccctccctgacccgtctcgtggcctccgaggctgaggatgngctgtattatatgctagctntattactcgtagtacgagttaacggtagggtttcggacgggtaggaccgtagcgtcgaccgtcgtacgtcgacgccgacgtccgtcccgccccgtcgtccacctccgttcccgtacccctccctccgtcgtaccg

SEQ ID NO: 279894 - DNA, 981 bp, Homo sapiens
  misc_feature: GYAE6OF01DP011.9.43.D10.1.454.CMB.1.raw
  modified_base (225)..(225): a, c, t, g, unknown or other
  misc_feature (225)..(225): n is a, c, g, or t
tcagtgatacgtctcacgaccggtgctcgatttagactagcagtaaggggggggtctcaggaggcagcgctctcaggacgtcaccaccatggcctgggctctgctcctcctcaccctcctcactcgagggcacgagggtcctgggcccagtctgccctgactcagccctccctccgcgtccggtctcctggacagtcagtccaccatctcctgcactcggaaccngctagttgggttggttatcgtacttagtcgtccttccgtgtactacaaacaaccaccgacggtaaccaaaccgaccccctaaagttccttagtacttttagtaggtaacggtaccaagggtacgggaccggtccccgtacggaccgggggttccctaggtacgttccggtcctttccgtcgtacggtacccttaccgtaacgttccgtaccggaacccgtaaacccggacccgggttaccccctttaccccggtaccggtacccccgtttccgttaccgggtccgggttaccccgtacccggtaacggggtccgtaacgggtaacgggtaccggttacggggtaacgggtccgtttaagggttttaaacgtttttaacggttttaacgtttcccgggtaacgttaacccggttaccccgtttaacgtttaaaccgttttaacggtttaacccggaacgggttaaacccgtttaaacggggtttaaaacccggggtttttaacgggggggttttacccggggaaccgggggtaaaccggggtaaacccggtaaacgggttacccggttacccgggttaaccccggtttacccgggttaaacgggtaccccgtaaaccggtacccccgggtaaaccgggttcccccggtaccccggttaccccccggtacccgggtttaacccgtaccccggttttcccgttaacccccggtttacccccccttaacccccgttccggttaaccccgttaaacccggg

SEQ ID NO: 279895 - DNA, 654 bp, Homo sapiens
  misc_feature: GYAE6OF02F26CX.9.43.D10.1.454.CMB.1.raw
  modified_base (312)..(312): a, c, t, g, unknown or other
  misc_feature (312)..(312): n is a, c, g, or t
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcattggtgttatgactatgtctcctggtatcaacaacacccaggcaaacgcccccaaactcttagatttatgaggtcagtaggagccctnacggggtcctgactcgcttctcgtggctccgaagtctgaccaacacggcctccctgacctctcgtcgggtctccgaggtcctagaggatggacggtcttaggtatttaatttagttcgctaagtcttactattaattcgaaggtccgtaagttaaacggttaggggtttttccgggacggtaacggggtaacccaaaggtccgtacggtaacccgttccgttaagggttaccaacggtaccccgtaaagggtcccttacccgggtccccccgttacggtacccttaacccggttccttaacccggtttaccccccaaccccgtttccctacccgtaacccgg

SEQ ID NO: 279896 - DNA, 681 bp, Homo sapiens
  misc_feature: GYAE6OF02FNKDZ.9.43.D10.1.454.CMB.1.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (466)..(466): a, c, t, g, unknown or other
  misc_feature (466)..(466): n is a, c, g, or t
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgttccgggtctcctggacagtcagtcaccatcctccngcactggagccacatgactttggtgttttaatcgtgtgtcctggtaaccaaaacncccaagcaaacgcccccaaactccctanatttanctacgtaccaacgtaacgccggacccctcgacgggtccctggttccgccttctctcggctaccagtccgtgacctaacaccggtcctccctggaccgttctcggtcggtcctaccaggtcctgacgacgtggacggcttaggatttagttactcggactagccttanaattacgcgccgtaaacgggccctaaccccgaataacgttcgttaccgtacggtaaccgggtagggaccccgtaacgggtccctaacccggtttcgaaccgggttcgaccggaccccgtaaacgggccccaaacccccgtaccggttcccttaacgaccccttttccggtccccggtttacccccgccccgttcccgttaccgaaggtaaccccg

SEQ ID NO: 279897 - DNA, 733 bp, Homo sapiens
  misc_feature: GYAE6OF02JL0O0.9.43.D10.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
tcagtgatacgtctcacgaccggtgctcgatttagactagcagtaaggggggggtctcaggaggcagcgctctcaggacgtcaccaccatggcctgggctctgctcctcctcaccctcctcactcagggcacgtacgggtccgtcgggcccctagttcctcggccctagacctcgacgtccctcccgtccggccggtcccgggtctccgtggacaggtcagtcaccgtactctcctcgacacgtcggaaccngctagttggtgttancgtactagtgtcctcgtagtactacaactaaccgccgagacaaccgaccctaatccttagtacttagtacggacgtacgaggtacggaccgtccggtcgtacgggtacctggtacgtccgttcttactcggtctaccgtacgtacggttctaccgaaccgtacgaccggtcccttcccggtacgtccgtccgttcgccgggtacctccggtacggtacgtcgggagtacggtacggtccggtgttacgtttaaagtttcttaaggtccgtaaccgtgttacgtaccgttattaccggtacggtaccgtacggtaaccggttaaggggtttacgggtccggggaaccgtagggtaaacgcgttacccgacggttaccctaggtaccggtacgtaccggccgttaaccgccgttcccggaccttcgtcctaccgttcccggcccgttcccgtaccttgcccgtaacgg

SEQ ID NO: 279898 - DNA, 203 bp, Homo sapiens
  misc_feature: GYAE6OF01CAZ3G.53.52.E08.1.454.CMB.1.raw
  modified_base (180)..(203): a, c, t, g, unknown or other
  misc_feature (180)..(203): n is a, c, g, or t
tcagcgcgtatacacacgaccggtgctcgatttagtcgagctctcgtcgtcggggcacgaccggtgctcgatttagctcgtacgctcaggcacgaccggtgctcgatttagtacacgtgacttagggattgggtgagtagggtaggcactcggtctgagcgggctggcaaggcgcatagnnnnnnnnnnnnnnnnnnnnnnnn

SEQ ID NO: 279899 - DNA, 141 bp, Homo sapiens
  misc_feature: GYAE6OF01D2ETT.53.52.E08.1.454.CMB.1.raw
  modified_base (132)..(141): a, c, t, g, unknown or other
  misc_feature (132)..(141): n is a, c, g, or t
tcagcgcgtatacacacgaccggtgctcgatttagtcgagctctctcggcgggcacgaccggtgctcgatttagtgtagtgtgaagggaaagggtacgcactcgtctgagcgggctggccaaggcgcatagnnnnnnnnnn

SEQ ID NO: 279900 - DNA, 230 bp, Homo sapiens
  misc_feature: GYAE6OF01EB9DW.53.52.E08.1.454.CMB.1.raw
  modified_base (210)..(210): a, c, t, g, unknown or other
  misc_feature (210)..(210): n is a, c, g, or t
  modified_base (221)..(230): a, c, t, g, unknown or other
  misc_feature (221)..(230): n is a, c, g, or t
tcagcgcgtatacacacgaccggtgctcgatttagtcgagctctctcggcggcacgaccggtgctcgatttagtcgagctcttcgcgggcacgaccggtgctcgatttagtcgagctctctcggcgggcacgaccggtgctcgatttagctctacgctcagggcacgaccggtgctcgatttagtatctgatgttgggttcagcggcgtncgagagcatannnnnnnnnn

SEQ ID NO: 279901 - DNA, 160 bp, Homo sapiens
  misc_feature: GYAE6OF01DMRIC.53.52.E08.1.454.CMB.1.raw
  modified_base (145)..(160): a, c, t, g, unknown or other
  misc_feature (145)..(160): n is a, c, g, or t
tcagcgcgtatacacacgaccggtgctcgatttagtcgagctctctcggcggcacgaccggtgctcgatttagtagtgtagattccgccggggatggcctccctcgagtctacagtgctctgagcgggctggcaaggcgcatagnnnnnnnnnnnnnnnn

SEQ ID NO: 279902 - DNA, 467 bp, Homo sapiens
  misc_feature: GYAE6OF01BSQQA.53.52.E08.1.454.CMB.1.raw
  modified_base (308)..(308): a, c, t, g, unknown or other
  misc_feature (308)..(308): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (413)..(415): a, c, t, g, unknown or other
  misc_feature (413)..(415): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (429)..(437): a, c, t, g, unknown or other
  misc_feature (429)..(437): n is a, c, g, or t
  modified_base (439)..(439): a, c, t, g, unknown or other
  misc_feature (439)..(439): n is a, c, g, or t
  modified_base (441)..(467): a, c, t, g, unknown or other
  misc_feature (441)..(467): n is a, c, g, or t
tcagcgcgtatacacacgaccggtgctcgatttagtcgagctctctcggcgggcacgaccggtgctcgatttagtcgagctctctcggcgggcacgaccggtgctcggattttagcgagctctctcggcgggcacggaccgggtgctcggattttagcgagctctctcggcgggcacgccggtgctcgatttagcgagctctctcggcggcacggccggtgctcgattttagcgatcctcttctcggcgggcacggccggtgccttacggaattttagcgagctcctgtcggcgggcaacgccgggtncgtacgtattcgcgagctctcgtcggcggcgacgcggtcgtcgtacgtagttacgtcgtcgtcgtgttcgtcggtcgcgacggtcgtcgcgcgagtacgngngtnnngcgncgcgncngtnnnnnnnnncngnnnnnnnnnnnnnnnnnnnnnnnnnnn

SEQ ID NO: 279903 - DNA, 206 bp, Homo sapiens
  misc_feature: GYAE6OF01A4KHE.53.52.E08.1.454.CMB.1.raw
  modified_base (191)..(206): a, c, t, g, unknown or other
  misc_feature (191)..(206): n is a, c, g, or t
tcagcgcgtatacacacgaccggtgctcgatttagtcgagctctctcggcgggcacgaccggtgctcgatttagtcgagctctctcgcgggcacggaccggtgctcgatttagtcgagctctctcgcgggcacggaccggtgctcgatttagatctgactagttgggttcagcggcgtgcaagcgcatagnnnnnnnnnnnnnnnn

SEQ ID NO: 279904 - DNA, 185 bp, Homo sapiens
  misc_feature: GYAE6OF02HS6KM.53.52.E08.1.454.CMB.1.raw
  modified_base (184)..(185): a, c, t, g, unknown or other
  misc_feature (184)..(185): n is a, c, g, or t
tcagcgcgtatacacacgaccggtgctcgatttagtcgagctctctctctcgggcacgaccggtgctcgatttagtcgagctctctcgcgggcacgaccggtgctcgatttagtcgagctctctcgcggcacggaccggtgctcgtatttagcagacgtctgcgcggctggcaaggcgcatagnn

SEQ ID NO: 279905 - DNA, 287 bp, Homo sapiens
  misc_feature: GYAE6OF02FZKPD.53.52.E08.1.454.CMB.1.raw
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (209)..(287): a, c, t, g, unknown or other
  misc_feature (209)..(287): n is a, c, g, or t
tcagcgcgtatacacacgaccggtgctcgatttagtcgagctctcgtcggcgggcacgaccggtgctcgatttagtcgagctctctcgcgggcacgaccggtgctcgatttagtcgagctctcgtcgcgggtacgaccggtgcttcgattttagcagtacgtctggagtcggggctggcaaggcgcaatgtncntngcngctgancgcnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 279906 - DNA, 169 bp, Homo sapiens
  misc_feature: GYAE6OF01B1UOK.47.38.D05.1.454.CMB.1.raw
  modified_base (168)..(169): a, c, t, g, unknown or other
  misc_feature (168)..(169): n is a, c, g, or t
tcagagctcacgtacacgaccggtgctcgatttagtatctgatagttggtttgggaagaggaagactgacggtcccaggagttcaggtgctgggcacagcggccctgggctgcctggtcaaggactacttcctacgtgagctctgagcgggctggcaaggcgcatagnn

SEQ ID NO: 279907 - DNA, 173 bp, Homo sapiens
  misc_feature: GYAE6OF01C2HUL.47.38.D05.1.454.CMB.1.raw
  modified_base (172)..(173): a, c, t, g, unknown or other
  misc_feature (172)..(173): n is a, c, g, or t
tcagagctcacgtacacgaccggtgctcgatttagtatctgatagttgggtttgggggaagaggaagactgacggtccccaggagttcaggtgctgggcacagcggccctgggctgcctggtcaaggactacttcctacgtgagctctgagcgggctggcaaggcgcatagnn

SEQ ID NO: 279908 - DNA, 355 bp, Homo sapiens
  misc_feature: GYAE6OF01DMYLA.47.38.D05.1.454.CMB.1.raw
  modified_base (352)..(355): a, c, t, g, unknown or other
  misc_feature (352)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcgccctgctccaggagcacctccgagagcacagcggccctgggctgcctggtcaaggactacttcctacgtgagctctgagcgggctggcaaggcgcatagnnnn

SEQ ID NO: 279909 - DNA, 390 bp, Homo sapiens
  misc_feature: GYAE6OF01AEP8N.47.38.D05.1.454.CMB.1.raw
  modified_base (386)..(390): a, c, t, g, unknown or other
  misc_feature (386)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnn

SEQ ID NO: 279910 - DNA, 385 bp, Homo sapiens
  misc_feature: GYAE6OF01BM08X.47.38.D05.1.454.CMB.1.raw
  modified_base (384)..(385): a, c, t, g, unknown or other
  misc_feature (384)..(385): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctggggcacagcggccctgggctgcctggtcaaggactacttcctacgtgagctctgagcgggctggcaaggcgcatagnn

SEQ ID NO: 279911 - DNA, 190 bp, Homo sapiens
  misc_feature: GYAE6OF01CHQSX.47.38.D05.1.454.CMB.1.raw
  modified_base (170)..(190): a, c, t, g, unknown or other
  misc_feature (170)..(190): n is a, c, g, or t
tcagagctcacgtacacgaccggtgctcgatttagtatctgatagttgggtttggggaagaggaagactgacggtccccaggagttcaggtgctgggcacagcggccctggctgcctggtcaaggactacttcctatgtatactctgagcgggctggcaaggcgcatagnnnnnnnnnnnnnnnnnnnnn

SEQ ID NO: 279912 - DNA, 390 bp, Homo sapiens
  misc_feature: GYAE6OF01BYOFK.47.38.D05.1.454.CMB.1.raw
  modified_base (385)..(390): a, c, t, g, unknown or other
  misc_feature (385)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcgccctgctccaggagcacctccgagagcacagcggccctgggctgcctggtcaaggactacttcctacgtgagctctgagcgggctggcaaggcgcatagnnnnnn

SEQ ID NO: 279913 - DNA, 387 bp, Homo sapiens
  misc_feature: GYAE6OF01DK74K.47.38.D05.1.454.CMB.1.raw
  modified_base (384)..(387): a, c, t, g, unknown or other
  misc_feature (384)..(387): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgtggcaaagggaccacggtcaccgtctcctcagcctccaccaaggcccatcggtcttcccctggcaccctcctccaagagcacctctgggggcacagcggccctgggctgcctggtcaaggactacttcctacgtgagctctgagcgggctggcaaggcgcatagnnnn

SEQ ID NO: 279914 - DNA, 230 bp, Homo sapiens
  misc_feature: GYAE6OF01CBSQ9.47.38.D05.1.454.CMB.1.raw
  modified_base (219)..(230): a, c, t, g, unknown or other
  misc_feature (219)..(230): n is a, c, g, or t
tcagagctcacgtacacgaccggtgctcgatttagtatctgatagttgggtggaggctgaggatgttggggtttattactgcatgcaagttctacaaacttcctacacttttggccaggggaccaagctggagatcaaacgaactgtggctgcaccatctgtcttcatcttcccgccatctgatacgtgagctctgagcgggctggcaaggcgcatagnnnnnnnnnnnn

SEQ ID NO: 279915 - DNA, 389 bp, Homo sapiens
  misc_feature: GYAE6OF01BVXUJ.47.38.D05.1.454.CMB.1.raw
  modified_base (385)..(389): a, c, t, g, unknown or other
  misc_feature (385)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggactacttcctacgtgagctctgagcgggctggcaaggcgcatagnnnnn

SEQ ID NO: 279916 - DNA, 474 bp, Homo sapiens
  misc_feature: GYAE6OF01BM5AO.47.38.D05.1.454.CMB.1.raw
  modified_base (311)..(311): a, c, t, g, unknown or other
  misc_feature (311)..(311): n is a, c, g, or t
  modified_base (465)..(474): a, c, t, g, unknown or other
  misc_feature (465)..(474): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggntcacggtcaccgtctcctcagcctccaccaagggcccatcggtcttccccctggcaccctcctccaagagcacctctgggggcacagcggcctgggctgcctggtcaaggctacttcctacgtgagctctgagcgggctggcaaggcgcatagnnnnnnnnnn

SEQ ID NO: 279917 - DNA, 172 bp, Homo sapiens
  misc_feature: GYAE6OF01ADLVG.47.38.D05.1.454.CMB.1.raw
  modified_base (172)..(172): a, c, t, g, unknown or other
  misc_feature (172)..(172): n is a, c, g, or t
tcagagctcacgtacacgaccggtgctcgatttagtatctgatagttgggtttgggggaagaggaagactgacggtccccaggagttcaggtgctgggcacagcggccctgggctgcctggtcaaggactacttcctacgtgagctctgagcgggctggcaaggcgcatagn

SEQ ID NO: 279918 - DNA, 173 bp, Homo sapiens
  misc_feature: GYAE6OF01EVIRU.47.38.D05.1.454.CMB.1.raw
  modified_base (173)..(173): a, c, t, g, unknown or other
  misc_feature (173)..(173): n is a, c, g, or t
tcagagctcacgtacacgaccggtgctcgatttagtatctgatagttgggtttgggggaagaggaagactgacggtcccccaggagttcaggtgctgggcacagcggccctgggctgcctggtcaaggactacttcctacgtgagctctgagcgggctggcaaggcgcatagn

SEQ ID NO: 279919 - DNA, 355 bp, Homo sapiens
  misc_feature: GYAE6OF01D1LL6.47.38.D05.1.454.CMB.1.raw
  modified_base (351)..(355): a, c, t, g, unknown or other
  misc_feature (351)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttcccctggcaccctcctccaagagcacctctgggggcacagcggccctgggctgcctggtcaaggactacttcctacgtgagctctgagcgggctggcaaggcgcatagnnnnn

SEQ ID NO: 279920 - DNA, 353 bp, Homo sapiens
  misc_feature: GYAE6OF01DVMZE.47.38.D05.1.454.CMB.1.raw
  modified_base (351)..(353): a, c, t, g, unknown or other
  misc_feature (351)..(353): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttcccctggcgccctgctccaggagcacctccgagagcacagcggccctgggctgcctggtcaaggactacttcctatgtatactctgagcgggctggcaaggcgcatagnnn

SEQ ID NO: 279921 - DNA, 388 bp, Homo sapiens
  misc_feature: GYAE6OF01D7LKO.47.38.D05.1.454.CMB.1.raw
  modified_base (384)..(388): a, c, t, g, unknown or other
  misc_feature (384)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcggctggcaaggcgcatagnnnnn

SEQ ID NO: 279922 - DNA, 390 bp, Homo sapiens
  misc_feature: GYAE6OF01CV978.47.38.D05.1.454.CMB.1.raw
  modified_base (386)..(390): a, c, t, g, unknown or other
  misc_feature (386)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggccaccctcctccaagagcacctctgggggcacagcggccctgggctgcctggtcaaggactacttcctacgtgagctctgagcgggctggcaaggcgcatagnnnnn

SEQ ID NO: 279923 - DNA, 390 bp, Homo sapiens
  misc_feature: GYAE6OF01BPLFD.47.38.D05.1.454.CMB.1.raw
  modified_base (386)..(390): a, c, t, g, unknown or other
  misc_feature (386)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggacctacttcctacgtgagctctgagcgggctggcaaggcgcatagnnnnn

SEQ ID NO: 279924 - DNA, 357 bp, Homo sapiens
  misc_feature: GYAE6OF01D8CXM.47.38.D05.1.454.CMB.1.raw
  modified_base (353)..(357): a, c, t, g, unknown or other
  misc_feature (353)..(357): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctggggcacagcggccctgggctgcctggtcaaggactacttcctacgtgagctctgagcgggctggcaaggcgcatagnnnnn

SEQ ID NO: 279925 - DNA, 391 bp, Homo sapiens
  misc_feature: GYAE6OF01BUJSW.47.38.D05.1.454.CMB.1.raw
  modified_base (386)..(391): a, c, t, g, unknown or other
  misc_feature (386)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnn

SEQ ID NO: 279926 - DNA, 365 bp, Homo sapiens
  misc_feature: GYAE6OF01BG8M3.47.38.D05.1.454.CMB.1.raw
  modified_base (360)..(365): a, c, t, g, unknown or other
  misc_feature (360)..(365): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnn

SEQ ID NO: 279927 - DNA, 386 bp, Homo sapiens
  misc_feature: GYAE6OF01EK0F4.47.38.D05.1.454.CMB.1.raw
  modified_base (384)..(386): a, c, t, g, unknown or other
  misc_feature (384)..(386): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggctacttcctacgtgagctctgagcgggctggcaaggcgcatagnnn

SEQ ID NO: 279928 - DNA, 179 bp, Homo sapiens
  misc_feature: GYAE6OF01BLWP3.47.38.D05.1.454.CMB.1.raw
  modified_base (174)..(179): a, c, t, g, unknown or other
  misc_feature (174)..(179): n is a, c, g, or t
tcagagctcacgtacacgaccggtgctcgatttagtatctgatagttgggtttgggggaaggaggaagactgacggtcccccaggagttcaggtgctgggcacagcggccctgggctgcctggtcaaggactacttcctacgtgagctctgagcgggctggcaaggcgcatagnnnnnn

SEQ ID NO: 279929 - DNA, 387 bp, Homo sapiens
  misc_feature: GYAE6OF01AY379.47.38.D05.1.454.CMB.1.raw
  modified_base (385)..(387): a, c, t, g, unknown or other
  misc_feature (385)..(387): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnn

SEQ ID NO: 279930 - DNA, 445 bp, Homo sapiens
  misc_feature: GYAE6OF01DTKEU.47.38.D05.1.454.CMB.1.raw
  modified_base (405)..(445): a, c, t, g, unknown or other
  misc_feature (405)..(445): n is a, c, g, or t
tcagagctcacgtacacgaccggtgctcgatttagtatctgatagttgggtttgggtgcccaagctgcgtggagggcacgggtcaccagtgaccagggacacgtccatcagtacagcctaccatggagctggacgcagtcctgacgacctgacgacacggccgtgtattattgtgcgttagttacggacgatttacggtacgtttttgagttggtcgacgttacccggacgtgtcgggggacaaaaggggccacgggtcaccgtctcctcagcctccacaagggccatcggtcttcccctggcaccctcctccaagagcacctctgggggcacagcggcctgggctgcctggtcaaaggactacttcctacgtgagctctgagcgggctggcaaggcgcgatagnnnnnnnnnnnnnnnnnnnnnnnnnnnnnnnnnnnnnnnnn

SEQ ID NO: 279931 - DNA, 391 bp, Homo sapiens; identical to SEQ ID NO: 279925
  misc_feature: GYAE6OF01A1DGZ.47.38.D05.1.454.CMB.1.raw
  modified_base (386)..(391): a, c, t, g, unknown or other
  misc_feature (386)..(391): n is a, c, g, or t

SEQ ID NO: 279932 - DNA, 510 bp, Homo sapiens
  misc_feature: GYAE6OF01BCA1S.47.38.D05.1.454.CMB.1.raw
  modified_base (318)..(318): a, c, t, g, unknown or other
  misc_feature (318)..(318): n is a, c, g, or t
  modified_base (507)..(507): a, c, t, g, unknown or other
  misc_feature (507)..(507): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagacgcctcttacatagtaatggattcaactatttgaattggtacctgcagaagccagggcagtctccacaactcctgatctatttggcttttaancggcctccgggtcctgacaggttcactggcagtggatcaggcacagtatttacattgaaatcagcagagtggagctgacggtgcgtggtatttatacgtgcatgacaagtactaaacaacttccttacaccttcggacctaaggacaacggactggactagttacgacgtaagtgtacgctagacactntcg

SEQ ID NO: 279933 - DNA, 472 bp, Homo sapiens
  misc_feature: GYAE6OF01CB6KC.47.38.D05.1.454.CMB.1.raw
  modified_base (465)..(472): a, c, t, g, unknown or other
  misc_feature (465)..(472): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggactactcctacgtgagctctgagcgggctggcaaggcgcatagnnnnnnnn

SEQ ID NO: 279934 - DNA, 389 bp, Homo sapiens
  misc_feature: GYAE6OF01DVEN3.47.38.D05.1.454.CMB.1.raw
  modified_base (386)..(389): a, c, t, g, unknown or other
  misc_feature (386)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnn

SEQ ID NO: 279935 - DNA, 386 bp, Homo sapiens
  misc_feature: GYAE6OF01CQ8W8.47.38.D05.1.454.CMB.1.raw
  modified_base (384)..(386): a, c, t, g, unknown or other
  misc_feature (384)..(386): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnn

SEQ ID NO: 279936 - DNA, 389 bp, Homo sapiens
  misc_feature: GYAE6OF01CNT52.47.38.D05.1.454.CMB.1.raw
  modified_base (386)..(389): a, c, t, g, unknown or other
  misc_feature (386)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnn

SEQ ID NO: 279937 - DNA, 559 bp, Homo sapiens
  misc_feature: GYAE6OF01ENTSA.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggtctgatcggcctccggggtcctgacaggttcagtggcagtggatcaggcacagtatttacgatagaaaatcgaggtagggtggaggcgtaggaggtagttgggtttaggggtttattacgtgtactagtgacgtaagttactaactaaacttaccttaactacgttttacggaccgtaacgggtaccgaaggtacgtaggacgtaacgtaacgaaaacggtaacgtaggtaggctgcctaaccg

SEQ ID NO: 279938 - DNA, 472 bp, Homo sapiens
  misc_feature: GYAE6OF01D78W0.47.38.D05.1.454.CMB.1.raw
  modified_base (463)..(472): a, c, t, g, unknown or other
  misc_feature (463)..(472): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggcctgtattattgtgcgttagttacggacgattacgacgttttgattggtcattacccggacgtgtgggcaaagggccacggtcaccgtctcctcagcctccaccaagggcccatcggtctcccctggcaccctcctccaagagcacctctggggcacagcggccctgggctgccctggtcaaggactattcctacgtgagctctgagcgggctggcaagggcgcatacgnnnnnnnnnn

SEQ ID NO: 279939 - DNA, 473 bp, Homo sapiens
  misc_feature: GYAE6OF01D86WA.47.38.D05.1.454.CMB.1.raw
  modified_base (466)..(473): a, c, t, g, unknown or other
  misc_feature (466)..(473): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggccatcggtcttccccctggcaccctcctccaagacgcacctctggggcacagcggccctgggctgcctggtcaaggctacttcctacgtgagctctgagcgggctggcaagggcgcatagnnnnnnnn

SEQ ID NO: 279940 - DNA, 391 bp, Homo sapiens
  misc_feature: GYAE6OF01B95LS.47.38.D05.1.454.CMB.1.raw
  modified_base (385)..(391): a, c, t, g, unknown or other
  misc_feature (385)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctggctgcctggtcaaggactacttcctacgtgagctctgagcgggctggcaaggcgcatagnnnnnnn

SEQ ID NO: 279941 - DNA, 392 bp, Homo sapiens
  misc_feature: GYAE6OF01CJGBC.47.38.D05.1.454.CMB.1.raw
  modified_base (384)..(392): a, c, t, g, unknown or other
  misc_feature (384)..(392): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaggactacttcctacgtgagcctgagcgggctggcaaggcgcatagnnnnnnnnn

SEQ ID NO: 279942 - DNA, 368 bp, Homo sapiens
  misc_feature: GYAE6OF01EVGBX.47.38.D05.1.454.CMB.1.raw
  modified_base (361)..(368): a, c, t, g, unknown or other
  misc_feature (361)..(368): n is a, c, g, or t
tcagagctcacgtacacgaccggtgctcgatttagtatctgatagttgggtttgggtggcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnnnnn

SEQ ID NO: 279943 - DNA, 569 bp, Homo sapiens
  misc_feature: GYAE6OF01BHZWK.47.38.D05.1.454.CMB.1.raw
  modified_base (467)..(467): a, c, t, g, unknown or other
  misc_feature (467)..(467): n is a, c, g, or t
  modified_base (485)..(485): a, c, t, g, unknown or other
  misc_feature (485)..(485): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (557)..(569): a, c, t, g, unknown or other
  misc_feature (557)..(569): n is a, c, g, or t
tcagagctcacgtacacgaccggtgctcgattttagtatctgatagtttgggttttggggtcgtcccaaggcctgctggagggcagggtcaccagtgacccagggacacgttccagtcccgagtacagcctaccatggagtcttgagcaagtctgagacctagacgacgacggccgtgtagttattgtgcgtttaggtttacggacgatttaacgaccgttttgacgttccggtacatttacccggacgttgtaggggacaaagggaccacggtcaccgtcgtccttacgacgcctccacctaacgggcccagtcggtcttccccgttggccgaccctccctccaagacgtcccaccgtcctagggggcacgaggccggcccctgggcctgcctggtcaagggactacgttcctacgtgagctctagacgcggggctgggacaagggcgtcgaacggttacggtcgnggagacagctgcgtctancgacgccaggctcgcccgtcgctctctctccncctccncacacgagtacgngngcgcgcgcgagcgnagngnnnnnnnnnnnnn

SEQ ID NO: 279944 - DNA, 391 bp, Homo sapiens
  misc_feature: GYAE6OF01EBSJ3.47.38.D05.1.454.CMB.1.raw
  modified_base (379)..(391): a, c, t, g, unknown or other
  misc_feature (379)..(391): n is a, c, g, or t
tcagagctcacgtacacgaccggtgctcgatttagtatctgataggttgggttgggtgcccaagctgctggagggcagggtcaccatgaccagggacacgtccatcagtacagcctacatggagctgagcagtctgagacctgacgacacggccgtgtattattgtgtgttagttacggacgattacgacgttttgattggtcattacccggacgtgtggggcaaagggaccacggtcaccgtctcctcagcctccaccaagggcccatcgctcccctggcaccctctccaagagcacctctggggcacagcggccctgggctgcctggtcaaggctacttccacgtgacgctctgagcgggctggcaaggcgcatagnnnnnnnnnnnnn

SEQ ID NO: 279945 - DNA, 399 bp, Homo sapiens
  misc_feature: GYAE6OF01EZ44E.47.38.D05.1.454.CMB.1.raw
  modified_base (341)..(341): a, c, t, g, unknown or other
  misc_feature (341)..(341): n is a, c, g, or t
  modified_base (371)..(399): a, c, t, g, unknown or other
  misc_feature (371)..(399): n is a, c, g, or t
tcagagctcacgtacacgaccggtgctcgatttagtatctgatagttgggtttggggtgcccaagctgctcggagggcacggtcaccacgcgtgctggagcagtctgagtacctgacgacacggtccggtgtattattgtgcgttagttacggacgattacgacgttttgattggttcattacccggacgtgtggggcaaaggggaccacggtcgacccgtctccgtcacgccgtccgaccaaggggcccagtccggtccttcccccctggcctaccctcctccaagagcacctcgtggggcacagcggccctgggctgcctgtcaggactactccacgtnagctctgagcgggctggcaaggcgcatagnnnnnnnnnnnnnnnnnnnnnnnnnnnnn

SEQ ID NO: 279946 - DNA, 354 bp, Homo sapiens
  misc_feature: GYAE6OF01DD4IO.47.38.D05.1.454.CMB.1.raw
  modified_base (351)..(354): a, c, t, g, unknown or other
  misc_feature (351)..(354): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggctacttcctacgtgagctctgagcgggctggcaaggcgcatagnnnn

SEQ ID NO: 279947 - DNA, 574 bp, Homo sapiens
  misc_feature: GYAE6OF01D4VVS.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgcccggcctccatctcctgcaggtctagccagagcctcttacatagtaatggattcaactatttgaattggtacctgacagaagccagggcagtcctaccacagctcctgatctgtttggtctgagtcgggcctccgaggtccctgactaggttcagtgcagtggatcgaggcaacgtagtattttacgactaagaaatacgaaggtagggtaggtaggcgtaggaggtagttggtttagggtttattacgtgtctagtgtactaagttacttaacgtaaacctttaccttaactacgttttcggaccgtacgggtaccgtaaggtcgtaggagtacgtacgaaacgtaacgtaggtacggtactagcctaccgtgtccg

SEQ ID NO: 279948 - DNA, 355 bp, Homo sapiens
  misc_feature: GYAE6OF01C5DC4.47.38.D05.1.454.CMB.1.raw
  modified_base (352)..(355): a, c, t, g, unknown or other
  misc_feature (352)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggccaccctcctccaagagcacctctgggggcacagcggccctgggctgcctggtcaaggactacttcctacgtgagctctgagcggctggcaaggcgcatagnnnn

SEQ ID NO: 279949 - DNA, 397 bp, Homo sapiens
  misc_feature: GYAE6OF01EA5UZ.47.38.D05.1.454.CMB.1.raw
  modified_base (392)..(397): a, c, t, g, unknown or other
  misc_feature (392)..(397): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtccttcccctggccaccctcctccaagagcacctcgtgggggcacgacgcggcccgtgggctgcctggtcaaggactacttcctacgtgacgctctgagcgggctggcaaggcgcatagnnnnnn

SEQ ID NO: 279950 - DNA, 356 bp, Homo sapiens
  misc_feature: GYAE6OF01AMC7U.47.38.D05.1.454.CMB.1.raw
  modified_base (353)..(356): a, c, t, g, unknown or other
  misc_feature (353)..(356): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnn

SEQ ID NO: 279951 - DNA, 389 bp, Homo sapiens
  misc_feature: GYAE6OF01BMS89.47.38.D05.1.454.CMB.1.raw
  modified_base (385)..(389): a, c, t, g, unknown or other
  misc_feature (385)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcggctggcaaggcgcatagnnnnn

SEQ ID NO: 279952 - DNA, 474 bp, Homo sapiens
  misc_feature: GYAE6OF01BP3SG.47.38.D05.1.454.CMB.1.raw
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
  modified_base (464)..(474): a, c, t, g, unknown or other
  misc_feature (464)..(474): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctaacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagngcacctctggggcacagcggccctgggctgcctggtcaaggctactcctacgtnagctctgagcgggctggcaaggcgcatagnnnnnnnnnnn

SEQ ID NO: 279953 - DNA, 483 bp, Homo sapiens
  misc_feature: GYAE6OF01CTZ8P.47.38.D05.1.454.CMB.1.raw
  modified_base (476)..(483): a, c, t, g, unknown or other
  misc_feature (476)..(483): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggcacccctcctccaacgacgcaacctctgggggcacagcggccctgggctgccctggtcaagggacctacttcctacgtgagctctgagcgggctggcaagggcgcatagnnnnnnnn

SEQ ID NO: 279954 - DNA, 221 bp, Homo sapiens
  misc_feature: GYAE6OF01EQSYQ.47.38.D05.1.454.CMB.1.raw
  modified_base (219)..(221): a, c, t, g, unknown or other
  misc_feature (219)..(221): n is a, c, g, or t
tcagagctcacgtacacgaccggtgctcgatttagtatctgatagttgggtggaggctgaggatgttggggtttattactgcatgcaagttctacaaacttcctacacttttggccaggggaccaagctggagatcaaacgaactgtggctgcaccatctgtcttcatcttcccgccatctgatacgtgagctctgagcgggctggcaaggcgcatagnnn

SEQ ID NO: 279955 - DNA, 360 bp, Homo sapiens
  misc_feature: GYAE6OF01D80ZY.47.38.D05.1.454.CMB.1.raw
  modified_base (359)..(360): a, c, t, g, unknown or other
  misc_feature (359)..(360): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactactcctacgtgagctctgagcgggctggcaaggcgcatagnn

SEQ ID NO: 279956 - DNA, 529 bp, Homo sapiens
  misc_feature: GYAE6OF01CFLV4.47.38.D05.1.454.CMB.1.raw
  modified_base (338)..(338): a, c, t, g, unknown or other
  misc_feature (338)..(338): n is a, c, g, or t
  modified_base (522)..(522): a, c, t, g, unknown or other
  misc_feature (522)..(522): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtcctgacnggttcagtggcagtggatcaggcacagtattttacgctagaaatcaggtagggtggaggctggaggtagttggtttaggggtttattacgtgctagtgactaagttctaactaactttacctactacgttttggccgaggggaccaagcgtaggagtatacgaaacgacgtgtgctgacacctntcgttcg

SEQ ID NO: 279957 - DNA, 366 bp, Homo sapiens
  misc_feature: GYAE6OF01C5UFP.47.38.D05.1.454.CMB.1.raw
  modified_base (359)..(366): a, c, t, g, unknown or other
  misc_feature (359)..(366): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnnnnnnn

SEQ ID NO: 279958 - DNA, 388 bp, Homo sapiens
  misc_feature: GYAE6OF01A2ORL.47.38.D05.1.454.CMB.1.raw
  modified_base (385)..(388): a, c, t, g, unknown or other
  misc_feature (385)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcggctggcaaggcgcatagnnnn

SEQ ID NO: 279959 - DNA, 174 bp, Homo sapiens
  misc_feature: GYAE6OF01C4XJG.47.38.D05.1.454.CMB.1.raw
  modified_base (173)..(174): a, c, t, g, unknown or other
  misc_feature (173)..(174): n is a, c, g, or t
tcagagctcacgtacacgaccggtgctcgatttagtatctgatagttgggtttgggggaagaggaagactgacggtcccccaggagttcaggtgctgggcacagcggccctgggctgcctggtcaaggactacttcctacgtgagctctgagcgggctggcaaggcgcatagnn

SEQ ID NO: 279960 - DNA, 354 bp, Homo sapiens
  misc_feature: GYAE6OF01DK6Z4.47.38.D05.1.454.CMB.1.raw
  modified_base (353)..(354): a, c, t, g, unknown or other
  misc_feature (353)..(354): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttccccctggccaccctcctccaagagcacctctgggggcacagcggccctgggctgcctggtcaaggactacttcctacgtgagctctgagcgggctggcaaggcgcatagnn

SEQ ID NO: 279961 - DNA, 534 bp, Homo sapiens
  misc_feature: GYAE6OF01EP00C.47.38.D05.1.454.CMB.1.raw
  modified_base (528)..(528): a, c, t, g, unknown or other
  misc_feature (528)..(528): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggttctgatcgggcctccggggtccctgacaggttcagtggcagtgatcgaggcacagtattttacgctagaaaatcgaggtagggtggaggcgtggaggtagttgggtttaggggtttattacgtgtcagtgactaagttcctaactaaacttcctaactacgtttaggccgtagggaccaagcgtggaagtatacaaacgactggtcggctgaccaccntcgtcg

SEQ ID NO: 279962 - DNA, 389 bp, Homo sapiens
  misc_feature: GYAE6OF01CDFEP.47.38.D05.1.454.CMB.1.raw
  modified_base (386)..(389): a, c, t, g, unknown or other
  misc_feature (386)..(389): n is a, c, g, or t
tcagagctcacgtacacgaccggtgctcgatttagtatctgatagttgggtttgggtgcccaagctgctggagggcaggatcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnn

SEQ ID NO: 279963 - DNA, 517 bp, Homo sapiens
  misc_feature: GYAE6OF01DVAUW.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgcaaaagccagggcagtctccacaactcctgatctatttggcttttaatcgggcctccgggtccctgacaggttcactggcagtggatcgaggcacagtattttacattagaaatcagcagagtggagctgacgatgctggtagtttatactgacagtgacaagactaaactaaccttccctttacacccttcggaccgaaagggacacggactaggacaagttagaacgaatgtggtcgtacg

SEQ ID NO: 279964 - DNA, 503 bp, Homo sapiens
  misc_feature: GYAE6OF01B0S3B.47.38.D05.1.454.CMB.1.raw
  modified_base (490)..(503): a, c, t, g, unknown or other
  misc_feature (490)..(503): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgatttacgacgttttgatttggtcattacccggacgtgtggggcaaagggaccacggtcaccgtctcctcagcctccaccaaggcccatcggtcttccccctggccacccctcctccaacgcgcaccctcgtgggggcacgacgccggcccgtggggcctggccctgggtacaacgggtactacttcctatcgtatactctgacgcgggctcgggcaaggcgcatagnnnnnnnnnnnnnn

SEQ ID NO: 279965 - DNA, 478 bp, Homo sapiens
  misc_feature: GYAE6OF01DEA5S.47.38.D05.1.454.CMB.1.raw
  modified_base (472)..(478): a, c, t, g, unknown or other
  misc_feature (472)..(478): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagacgcacctcgtgggggcacgagccggccctgggctgcctggtcaaggactacttcctacgtgagctctgagcgggctggcaagggcgcatagnnnnnnn

SEQ ID NO: 279966 - DNA, 361 bp, Homo sapiens
  misc_feature: GYAE6OF01EFX08.47.38.D05.1.454.CMB.1.raw
  modified_base (360)..(361): a, c, t, g, unknown or other
  misc_feature (360)..(361): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnn

SEQ ID NO: 279967 - DNA, 391 bp, Homo sapiens
  misc_feature: GYAE6OF01EIXGN.47.38.D05.1.454.CMB.1.raw
  modified_base (386)..(391): a, c, t, g, unknown or other
  misc_feature (386)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcgccctgctccaggagcacctctgggggcacagcggccctgggctgcctggtcaaggactacttcctacgtgagctctgagcgggctggcaaggcgcatagnnnnnn

SEQ ID NO: 279968 - DNA, 420 bp, Homo sapiens
  misc_feature: GYAE6OF01AI3E9.47.38.D05.1.454.CMB.1.raw
  modified_base (401)..(420): a, c, t, g, unknown or other
  misc_feature (401)..(420): n is a, c, g, or t
tcagagctcacgtacacgaccggtgctcgatttagtatctgatagttggggtttgggtgcccaagctgctggagggcagggtcaccatgaccagggacacgtccatcaggtacagcctacatggagctgagcagtctagagacctgacgacacggccgtgtattattgtgccgttagttacggacgattacgacgtttttgatttgggtcattacccggagttgtggggcaaaaggggccacgggtcaccgtctcctcagcctccaccaaggggcccatccggtcttccccctggccaccctcctccaaggagccacctctgggggcaccagcggccctgggcttgcctggtcaaggctactcctacgtgagctctgagcggctggcaaggcgcacgtagnnnnnnnnnnnnnnnnnnnn

SEQ ID NO: 279969 - DNA, 386 bp, Homo sapiens
  misc_feature: GYAE6OF01CT9IU.47.38.D05.1.454.CMB.1.raw
  modified_base (383)..(386): a, c, t, g, unknown or other
  misc_feature (383)..(386): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggccatcggtcttcccctggcgccctgctccaggagcacctccgagacgcacagcggccctgggctgcctggtcaaggactacttcctacgtgagctctgagcgggctggcaggcgcatagnnnn

SEQ ID NO: 279970 - DNA, 388 bp, Homo sapiens
  misc_feature: GYAE6OF01EVSE3.47.38.D05.1.454.CMB.1.raw
  modified_base (385)..(388): a, c, t, g, unknown or other
  misc_feature (385)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacgagcggccctgggctgcctggtcaaggactacttcctacgtgagctctgagcggctggcaaggcgcatagnnnn

SEQ ID NO: 279971 - DNA, 503 bp, Homo sapiens
  misc_feature: GYAE6OF01DGIYQ.47.38.D05.1.454.CMB.1.raw
  modified_base (491)..(503): a, c, t, g, unknown or other
  misc_feature (491)..(503): n is a, c, g, or t
tcagagctcacgtacacgaccggtgctcgatttagtatctgatagttgggtttgggtgcccaagctgctggaggacacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgtcgttagttacggacgattacgacgttttgattggtctattacccggacgtgtggggcaaagggaccacggtcaccgtctcctcagcctccaccgaacggccatcggtcttccccctggccaccctcctaccaagacgccaccgtcgtcgggggcacgacgcggcccgtgggctcgccctggtacgaacggtactacttccgtacgtcgacgctccgtgacgcgggctggacaggcgcatagnnnnnnnnnnnnn

SEQ ID NO: 279972 - DNA, 592 bp, Homo sapiens
  misc_feature: GYAE6OF01ARWLD.47.38.D05.1.454.CMB.1.raw
  modified_base (290)..(290): a, c, t, g, unknown or other
  misc_feature (290)..(290): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagccagacgcctcttacatagtaatggattcaacttattgaattggtacctgcagaagccagggcagtcnccacagctcctgatcttgtttgggtctgagtccgggcccgttccggggtcctggactaggttcaggtggcagtggactcgaggcacagttaactttacgcgtagtaaatcgtaggtagggtggaggtcgtaggaggtagttgggtttagggtttattacgtgcgtagtcgtactaacgttctaacgtaacctttaccttaacgttacgttttacggaccgtaaggggaccgtaacggtcgtagggtaacgtaagtaacgaaacggacgttaggtacggtctacgaccactagttccgttacg

SEQ ID NO: 279973 - DNA, 361 bp, Homo sapiens
  misc_feature: GYAE6OF01A819T.47.38.D05.1.454.CMB.1.raw
  modified_base (359)..(361): a, c, t, g, unknown or other
  misc_feature (359)..(361): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnn

SEQ ID NO: 279974 - DNA, 390 bp, Homo sapiens
  misc_feature: GYAE6OF01A167G.47.38.D05.1.454.CMB.1.raw
  modified_base (387)..(390): a, c, t, g, unknown or other
  misc_feature (387)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnn

SEQ ID NO: 279975 - DNA, 386 bp, Homo sapiens
  misc_feature: GYAE6OF01CDVII.47.38.D05.1.454.CMB.1.raw
  modified_base (385)..(386): a, c, t, g, unknown or other
  misc_feature (385)..(386): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggccacggtcaccgtctcctcagcctccaccaagggcccatcggtcttcccctggcaccctcctccaagagcacctctgggggcacagcggccctgggctgcctggtcaaggactacttcctacgtgagctctgagcgggctggcaaggcgcatagnn

SEQ ID NO: 279976 - DNA, 390 bp, Homo sapiens
  misc_feature: GYAE6OF01CSPS4.47.38.D05.1.454.CMB.1.raw
  modified_base (385)..(390): a, c, t, g, unknown or other
  misc_feature (385)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccacaagggcccatcggtcttcccctggccaccctcctccaagagcacctcgtgggggcacagcggccctggctgcctggtcaaggactacttcctacgtgagctctgagcgggctggcaaggcgcatagnnnnnn

SEQ ID NO: 279977 - DNA, 390 bp, Homo sapiens
  misc_feature: GYAE6OF01ACLGH.47.38.D05.1.454.CMB.1.raw
  modified_base (385)..(390): a, c, t, g, unknown or other
  misc_feature (385)..(390): n is a, c, g, or t
tcagagctcacgtacacgaccggtgctcgatttagtatctgatagttgggtttgggtgcccaagctgctggagggcagggtcaccatgaccaggtacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnn

SEQ ID NO: 279978 - DNA, 174 bp, Homo sapiens; identical to SEQ ID NO: 279959
  misc_feature: GYAE6OF01B9S9J.47.38.D05.1.454.CMB.1.raw
  modified_base (173)..(174): a, c, t, g, unknown or other
  misc_feature (173)..(174): n is a, c, g, or t

SEQ ID NO: 279979 - DNA, 368 bp, Homo sapiens
  misc_feature: GYAE6OF01ESSG9.47.38.D05.1.454.CMB.1.raw
  modified_base (345)..(345): a, c, t, g, unknown or other
  misc_feature (345)..(345): n is a, c, g, or t
  modified_base (358)..(368): a, c, t, g, unknown or other
  misc_feature (358)..(368): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgccctggtcaaggactacttcctacgtgagctctgagcgggctcgggngcaggcgcatagnnnnnnnnnnn

SEQ ID NO: 279980 - DNA, 550 bp, Homo sapiens
  misc_feature: GYAE6OF01BECB8.47.38.D05.1.454.CMB.1.raw
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagccgtggggcctcagtgaaggtctccgtgcaaggcttctggatacagcttcaccgactactattgcacgtggtgcgaccggccctggacgaagggcttggagtggatgggacgatcgacgcctaacagtggtgcaacaaactatgacacagtaggtttcgagggcagggtcacgatcgacgaggacacgtccatcgagtacacgcctacngtggancgtgagcagtctaggacacgtgacgacgaccggtccgtgttacttagttcggtagtaccggtttaggttaccggagttacgttacgttacggtttaggttacgtttggtcgttaacccgg

SEQ ID NO: 279981 - DNA, 589 bp, Homo sapiens
  misc_feature: GYAE6OF01DFTUD.47.38.D05.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcaccccgtggagacgcccggcctccatcctcctgcaggtctagccagacgcctcttacatagtaatggattacaacttattgaattggtacctgcagaacgcgagggcagtcnccacagcctccngattcgttgtttgggtctgacgtccgggcctccggggtcctgacgtaggttcaggtggctaggtggatcgaggctacgagttatttacgactaagaaatcgaggtagggtaggaggcgtaggaggtagttgggttagggtttattagtgactagtcgtactaacgttactaacctaacctttccttaacgttacgtttacggaccgtaacgggtaccgaaggtacgtagggtaacgtaataacgaaacgtaacgtgtacggtactacgacactagtcgttacg

SEQ ID NO: 279982 - DNA, 404 bp, Homo sapiens
  misc_feature: GYAE6OF01AFIWV.47.38.D05.1.454.CMB.1.raw
  modified_base (393)..(404): a, c, t, g, unknown or other
  misc_feature (393)..(404): n is a, c, g, or t
tcagagctcacgtacacgaccggtgctcgatttagtatctgatagttgggtttgggtgcccaagctgctggagggcaggatcaccatgaccagggacacgtccatcagtacagcctacatggagctgagcagtctgagacctgacgacacggccgtgtattattgtgcgttagttacggacgattacgacgttttgattggtcattacccggacgtgtggggacaaaggggccacggtcaccgtctcctcagccctccaccgaagggccccatcggtcttcccccctggccaccctcctccaagagcacctctgggggcacagcggccctgggctgcctggtcaaggactacttcctacgtgacgctctgagcgggctggcaaggcgcatagnnnnnnnnnnnn

SEQ ID NO: 279983 - DNA, 192 bp, Homo sapiens
  misc_feature: GYAE6OF01CV3OP.47.38.D05.1.454.CMB.1.raw
  modified_base (105)..(105): a, c, t, g, unknown or other
  misc_feature (105)..(105): n is a, c, g, or t
  modified_base (178)..(192): a, c, t, g, unknown or other
  misc_feature (178)..(192): n is a, c, g, or t
tcagagctcacgtacacgaccggtgctcgatttagtatctgatagttgggtttgggggaagagggaagactgacggtcccccaggagttcaggtgctccccgggnacagcggccctgggctgcctggtcaaggactacttcctacgtgagctctgagcgggctggcaaggcgcatagnnnnnnnnnnnnnnn

SEQ ID NO: 279984 - DNA, 365 bp, Homo sapiens
  misc_feature: GYAE6OF01DGAXO.47.38.D05.1.454.CMB.1.raw
  modified_base (360)..(365): a, c, t, g, unknown or other
  misc_feature (360)..(365): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcacccctcctccaagagcacctctgggggcacagcggccctgggctgcctggtcaaggctacttcctacgtgagctctgagcgggctggcaaggcgcatagnnnnnn

SEQ ID NO: 279985 - DNA, 393 bp, Homo sapiens
  misc_feature: GYAE6OF01EF9CT.47.38.D05.1.454.CMB.1.raw
  modified_base (385)..(393): a, c, t, g, unknown or other
  misc_feature (385)..(393): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtctcccctggccaccctcctccaagagcacctctgggggcacagcggccctgggctgcctggtcaaggactacttcctacgtgagctctgagcgggctggcaaggcgacatagnnnnnnnnn

SEQ ID NO: 279986 - DNA, 486 bp, Homo sapiens
  misc_feature: GYAE6OF01C8WQM.47.38.D05.1.454.CMB.1.raw
  modified_base (478)..(486): a, c, t, g, unknown or other
  misc_feature (478)..(486): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaagggaccacggtcacgtctcctcagcctccaccaagggccatcggtcttcccctggcaccctcctccaagacgcacctctcgggggcacgacgcggccccgtcgggctcggcccgtggtcaaacggactacgttcctacgtgacgctctgagcgggctggcaaggcgcatagnnnnnnnnn

SEQ ID NO: 279987 - DNA, 389 bp, Homo sapiens; identical to SEQ ID NO: 279962
  misc_feature: GYAE6OF01AG7BE.47.38.D05.1.454.CMB.1.raw
  modified_base (386)..(389): a, c, t, g, unknown or other
  misc_feature (386)..(389): n is a, c, g, or t

SEQ ID NO: 279988 - DNA, 558 bp, Homo sapiens
  misc_feature: GYAE6OF01C45FF.47.38.D05.1.454.CMB.1.raw
  modified_base (522)..(522): a, c, t, g, unknown or other
  misc_feature (522)..(522): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtgggggatattgtgatgactcagtctccactctccctgcccgtcacccctggagagccggcctccatctcctgcaggtctagccagagcctcttacatagtaatggattcaactatttgaattggtacctgcagaagccgagggcacgtctccacagctcctgatctggtttgggttctgactcgggccgttccggggtccctgactaggttcaggtggcgtagtggatcgaggcacgtagtacttttacgactagaaaatcgaaggtagggtggtagggcgttaggagggtagttgggtttaggggttttattaacgtgtactagtgactaagttctaactaaccttctactacgtttcggccgtagggaccgaagntaggacgatacgaaacgtacgtagtgctgctaaccg

SEQ ID NO: 279989 - DNA, 252 bp, Homo sapiens
  misc_feature: GYAE6OF01EBZ27.47.38.D05.1.454.CMB.1.raw
  modified_base (230)..(252): a, c, t, g, unknown or other
  misc_feature (230)..(252): n is a, c, g, or t
tcagagctcacgtacacgaccggtgctcgatttagtatctgatagttgggtttgggtgcccaagctgctggagggcacggtcaccgtctcctcagcctccaccaagggcccatcggtcttcccctggcaccctcctccaagagcacctcgtgggggcacagcggccctgggctgcctggtcaaggactacttcctatgtatactctgagcgggctggcaaggcgcatagnnnnnnnnnnnnnnnnnnnnnnn

SEQ ID NO: 279990 - DNA, 362 bp, Homo sapiens
  misc_feature: GYAE6OF01E0PFF.47.38.D05.1.454.CMB.1.raw
  modified_base (360)..(362): a, c, t, g, unknown or other
  misc_feature (360)..(362): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnn

SEQ ID NO: 279991 - DNA, 394 bp, Homo sapiens
  misc_feature: GYAE6OF01DX4DN.47.38.D05.1.454.CMB.1.raw
  modified_base (387)..(394): a, c, t, g, unknown or other
  misc_feature (387)..(394): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagacgcacctctgggggcacagcggccctgggctgcctggtcaaggctacttcctacgtgagctctgagcgggctggcaaggcgcatagnnnnnnnn

SEQ ID NO: 279992 - DNA, 364 bp, Homo sapiens
  misc_feature: GYAE6OF01CPU75.47.38.D05.1.454.CMB.1.raw
  modified_base (360)..(364): a, c, t, g, unknown or other
  misc_feature (360)..(364): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 279993 - DNA, 389 bp, Homo sapiens
  misc_feature: GYAE6OF01E3JQR.47.38.D05.1.454.CMB.1.raw
  modified_base (385)..(389): a, c, t, g, unknown or other
  misc_feature (385)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctatgtatactctgagcgggctggcaaggcgcatagnnnnn

SEQ ID NO: 279994 - DNA, 596 bp, Homo sapiens
  misc_feature: GYAE6OF01CHF97.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaacttatttgaattggtacctgcagaagccagggcagtctccacagctcctgatcgttgtttgggttctggagtccgggccgtccgggggtccctggacgtaggttcaggtggcaggtggatcgaggcacgagtatttacgactagaaatcgaggtagggtaggaggcgtaggaggtagttgggtttagggtttaattacgtgtctagtgtacgtaagttactaacctaaactttcctaacgttacgttttacgggacccgtacgggggaaccctaaggtacgtagggaacgtaagtaacgaaaaccggtaacgtggttacggcttacggaccacctattccgttacg

SEQ ID NO: 279995 - DNA, 360 bp, Homo sapiens
  misc_feature: GYAE6OF01CM26O.47.38.D05.1.454.CMB.1.raw
  modified_base (353)..(360): a, c, t, g, unknown or other
  misc_feature (353)..(360): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnnn

SEQ ID NO: 279996 - DNA, 391 bp, Homo sapiens
  misc_feature: GYAE6OF01CPP2K.47.38.D05.1.454.CMB.1.raw
  modified_base (385)..(391): a, c, t, g, unknown or other
  misc_feature (385)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnn

SEQ ID NO: 279997 - DNA, 539 bp, Homo sapiens
  misc_feature: GYAE6OF01APFYS.47.38.D05.1.454.CMB.1.raw
  modified_base (341)..(341): a, c, t, g, unknown or other
  misc_feature (341)..(341): n is a, c, g, or t
  modified_base (495)..(495): a, c, t, g, unknown or other
  misc_feature (495)..(495): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagccagagcctcttacatagtaatggattcaactatttgaattggtacctgcagaagccaggcagtcctccacagctcctgatctgtttcgggttctgatcgggcctccggggtcctgacgnggttcagtggcagtggactcgaggcacagtattttacgctagaaatcgaggtagggtggaggcgtggaggtagttggtttggggtttatttacgtgctatgactaagttcctaacgtaaacttccttaactacgtttggaccaggggaccaagngtaggagatacgaaacgtacgtaggtcgctcgcacctatcttcg

SEQ ID NO: 279998 - DNA, 386 bp, Homo sapiens
  misc_feature: GYAE6OF01CAN3Q.47.38.D05.1.454.CMB.1.raw
  modified_base (384)..(386): a, c, t, g, unknown or other
  misc_feature (384)..(386): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacaattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcggctggcaaggcgcatagnnn

SEQ ID NO: 279999 - DNA, 391 bp, Homo sapiens
  misc_feature: GYAE6OF01BB3G6.47.38.D05.1.454.CMB.1.raw
  modified_base (385)..(391): a, c, t, g, unknown or other
  misc_feature (385)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggacaaagggaccacggtcaccgtctcctcagcctccaccaagggcccatcggtcttccccctggcaccctcctccaagagcacctctgggggcacagcggccctgggctgcctggtcaaggactactcctacgtgagctctgagcgggctggcaaggcgcatagnnnnnnn

SEQ ID NO: 280000 - DNA, 585 bp, Homo sapiens
  misc_feature: GYAE6OF01D0G9B.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagccagagcctcttacatagtaatggattcaactatttgaattggtacctgcagaagccgagggcagtcctccacagctcctgattcgttggttttgggttctgtacgtccgggtcccgttcccgggggtccctggaccgtaggttccaggtggcgaggtggatcgaggcaacgagtacttttacgctagaaagtcgaggtagggtggaggcgtaggaggtagttggtttagggtttattacgtgactagtgtacgtaagttctaacctaactttaccttactacgtttcggaccgtaagggacctaaggtcgtaggaacgtataacgaaacgtacgtggtacggtctacgacacctagtcttacg

SEQ ID NO: 280001 - DNA, 363 bp, Homo sapiens
  misc_feature: GYAE6OF01ATZCT.47.38.D05.1.454.CMB.1.raw
  modified_base (355)..(363): a, c, t, g, unknown or other
  misc_feature (355)..(363): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggccaccctcctccaagacgcacctcgtgggggcacagcggccctgggctgcctggtcaaggactacttcctacgtgagctctgagcgggctggcaaggcgcatagnnnnnnnnn

SEQ ID NO: 280002 - DNA, 574 bp, Homo sapiens
  misc_feature: GYAE6OF01DNONS.47.38.D05.1.454.CMB.1.raw
  modified_base (562)..(562): a, c, t, g, unknown or other
  misc_feature (562)..(562): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatcctcctgtaggtctagccagagcctcttacatagtaatggattcaactatttgaattggtacctgcagagccagggcagtctccacagcctcctgattcgttggtttgggttctggtacgtccggggcccgttccggggtccctggactaggtttcaggtggcaggtggatcgaggcatagtacttttacgacttagaaaatcgtaaggtagggtggaggcgtggaggtagttgggtttaggggttttatttacgtgtctaagtgactaagttactaactaaactttcctacgtacgtttcggaccgacggggaccaagtcgtaggagtacgtacgaaacgacgtggtagntcgcaccgtacg

SEQ ID NO: 280003 - DNA, 471 bp, Homo sapiens
  misc_feature: GYAE6OF01CNP0I.47.38.D05.1.454.CMB.1.raw
  modified_base (357)..(357): a, c, t, g, unknown or other
  misc_feature (357)..(357): n is a, c, g, or t
  modified_base (459)..(471): a, c, t, g, unknown or other
  misc_feature (459)..(471): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctcaccaggccatcggtctccccngcacctcctcaagcgcacctcgtggggcacgagcggcctgggctgcctggtcaaggctacttcctacgtcgagctctgacgcgggctggcaaggcgcatagnnnnnnnnnnnnn

SEQ ID NO: 280004 - DNA, 388 bp, Homo sapiens
  misc_feature: GYAE6OF01EM42B.47.38.D05.1.454.CMB.1.raw
  modified_base (384)..(388): a, c, t, g, unknown or other
  misc_feature (384)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggaccacggtcaccgtctcctcagcctccaccaagggcccatcggcttcccctggcgccctgctccaggagcacctccgagagcacagcggccctgggctgcctggtcaaggactacttccacgtgagctctgagcgggctggcaaggcgcatagnnnnn

SEQ ID NO: 280005 - DNA, 387 bp, Homo sapiens
  misc_feature: GYAE6OF01EY9A4.47.38.D05.1.454.CMB.1.raw
  modified_base (386)..(387): a, c, t, g, unknown or other
  misc_feature (386)..(387): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnn

SEQ ID NO: 280006 - DNA, 354 bp, Homo sapiens
  misc_feature: GYAE6OF01DJTMX.47.38.D05.1.454.CMB.1.raw
  modified_base (352)..(354): a, c, t, g, unknown or other
  misc_feature (352)..(354): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnn

SEQ ID NO: 280007 - DNA, 364 bp, Homo sapiens
  misc_feature: GYAE6OF01ES4BH.47.38.D05.1.454.CMB.1.raw
  modified_base (349)..(364): a, c, t, g, unknown or other
  misc_feature (349)..(364): n is a, c, g, or t
tcagagctcacgtacacgaccggtgctcgatttagtatctgatagttgggtttgggtgcccgaagctgctggagggcacggtcaccacgctgctgagcagtctgagaccctgacgacacggccgtgtattattgtgcgttagttacggacgattacgacgttttgattggtcattacccggacgtgtggggcaaagggccacggtcaccgtctcctcagcctccacaaggcccatcggtcttccccctggcaccctctcaagagcacctctggggcacagcggccctgggctgcctggtcaaggactacttcctatgtatactctgagcgggctggcaaggctcatagnnnnnnnnnnnnnnnn

SEQ ID NO: 280008 - DNA, 398 bp, Homo sapiens
  misc_feature: GYAE6OF01ET84J.47.38.D05.1.454.CMB.1.raw
  modified_base (376)..(376): a, c, t, g, unknown or other
  misc_feature (376)..(376): n is a, c, g, or t
  modified_base (392)..(398): a, c, t, g, unknown or other
  misc_feature (392)..(398): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattatgtgcgttagttacggacgattacgtacgttttgattggtcattacccggacgtgtggggacaaagggaccacggtcaccgtctcctcacgcctccaccaagggcccatcggtcttcccctggccaccctcctccaagagcacctcgtgggggcacgagccggcccgtgggcctgcctggtcaaggactacttcctatgtatactctgagcggntggcaaggcgcatagnnnnnnn

SEQ ID NO: 280009 - DNA, 392 bp, Homo sapiens
  misc_feature: GYAE6OF01ER19M.47.38.D05.1.454.CMB.1.raw
  modified_base (380)..(380): a, c, t, g, unknown or other
  misc_feature (380)..(380): n is a, c, g, or t
  modified_base (386)..(392): a, c, t, g, unknown or other
  misc_feature (386)..(392): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtccttccccctggcaccctcctccaagagcacctctgggggcacagcggccctgggctgcctggtcaaggactacttcctacgtgagctctgagcgggctggcaaggcncatagnnnnnnn

SEQ ID NO: 280010 - DNA, 606 bp, Homo sapiens
  misc_feature: GYAE6OF01EOPFE.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagacgcctcttacatagtaatggattcaactatttgaattggtacctgcagaagccagggcagtctccacagctcctgatcttgtttgggttctgagtcgggcctccggggtcctgacgaggttcagtggcaggtggatcgaggcacgagtattttacgctagaaatcgaggtagggtggaggcgtggaggtagtttgggtttggggtttaattacgtgactagtgacgtaacgttactaactaaacctttcccttaacgttaccgttttacgggacccggtaacgggggtaacccaaacggtcgttagggaacgtaataaccggtaaaaccggtaaccgttggtacgggtcgttacggaccctaaccctagttcccgttacgg

SEQ ID NO: 280011 - DNA, 388 bp, Homo sapiens
  misc_feature: GYAE6OF01DF2GK.47.38.D05.1.454.CMB.1.raw
  modified_base (387)..(388): a, c, t, g, unknown or other
  misc_feature (387)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaagggccacggtcaccgtctcctcagcctccaccaagggccccatcggtcttccccctggcaccctcctccaagagcacctctgggggcacagcggccctgggctgcctggtcaaggactacttcctacgtgagctctgagcgggctggcaaggcgcatagnn

SEQ ID NO: 280012 - DNA, 355 bp, Homo sapiens
  misc_feature: GYAE6OF01AEQM9.47.38.D05.1.454.CMB.1.raw
  modified_base (352)..(355): a, c, t, g, unknown or other
  misc_feature (352)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctgcaccctcctccaagagcacctcgtgggggcacagcggccctgggcttcctggtcaaggactacttcctacgtgagctctgagcgggctggcaaggcgcatagnnnn

SEQ ID NO: 280013 - DNA, 580 bp, Homo sapiens
  misc_feature: GYAE6OF01BUTRW.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtgggatattgtgatgactcagtctccactctccctgcccgtcacccctggagagccggcctccatctcctgcaggtctagccagagcctcttacatagtaatggattcaactattgaattggtacctgcagaagccaggcagtctccacagctctgatcgtgtttggtctgatcgggcctccggggtcctgacgtaggttcagtggcaggtgatcgaggcacgtagtatttacgctagaaatcgaaggtaggtggaggtcgtaggaggtagttggtttaggggtttattacgtgtactagtagacgtaagttacgtaactaaacttacccttaacttacgttttacgggacccgtagggaaccaaacggtacgtagggtaacgtaagtaccgaaaacgtaacgtaggtacggtcgttacgacctaacctagttccgttacg

SEQ ID NO: 280014 - DNA, 366 bp, Homo sapiens
  misc_feature: GYAE6OF01CMBGH.47.38.D05.1.454.CMB.1.raw
  modified_base (361)..(366): a, c, t, g, unknown or other
  misc_feature (361)..(366): n is a, c, g, or t
tcagagctcacgtacacgaccggtgctcgatttagtatctgatagttgggtttgggtgcccaagctgctggagggcacggtcaccacgctgctgagggagtagagtccctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacgagcggccctgggctgcctggtcaaggactacttcctacgtgagctctgagcgggctggcaaggcgcatagnnnnnn

SEQ ID NO: 280015 - DNA, 392 bp, Homo sapiens
  misc_feature: GYAE6OF01DCUK9.47.38.D05.1.454.CMB.1.raw
  modified_base (385)..(392): a, c, t, g, unknown or other
  misc_feature (385)..(392): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattattgtgcgttagttacggacgattacgacgttttgattggtcattactcggacgtgtggggcaaagggaccacggtcaccgtctcctcagcctcaccaaggccatcggtctcccctggcaccctcctccaagagcacctctgggggcacagcggccctgggctcgcctggtcaaggacctacttcctacgtgagctctgaggcgggctggcaaggcgcaatagnnnnnnnn

SEQ ID NO: 280016 - DNA, 671 bp, Homo sapiens
  misc_feature: GYAE6OF01EADTI.47.38.D05.1.454.CMB.1.raw
tcagagctcacgtacacgaccggtgctcgatttagtatctgatagttgggtttggggtgatcaggactcctcagttcaccttctcacaatgaggctccctgctcagctccgtggggctgctaatgctctgggtctctggatccagtgggatattgtgatgactcagtctccactcctccctcgcccgtccaccccgtggacgacgcccggcctccatctcctgcaggtctagccagacgtccttacttacattaagtaatggtacttacaaacttatttagaatttcggtacctgacaagaacgccgagggctagtcctaccacgacgtcctccgtagtacttcgtttggttttcgggttctggacgttccggggtcccgttcccgggggtccctggacgtacgggttcgaggtcggacgtaggtcggactcgacggacaacgtagttacgtttacgacgtaagtaaagtcgaagggtagggtggaggtcgtaggtaggttaggtttgggtttagggtttattacgtgtacgtagtacgtacgttaacgtttaccttaacgttaaccgtttaccttaacgttacgtttaccggaccggtaacgggtaacccgtaggtacgtaggtaacgtaactaacgaaacgtacgttacggtacggtctcgcctaaccg

SEQ ID NO: 280017 - DNA, 395 bp, Homo sapiens
  misc_feature: GYAE6OF01EBVSW.47.38.D05.1.454.CMB.1.raw
  modified_base (379)..(379): a, c, t, g, unknown or other
  misc_feature (379)..(379): n is a, c, g, or t
  modified_base (384)..(395): a, c, t, g, unknown or other
  misc_feature (384)..(395): n is a, c, g, or t
tcagagctcacgtacacgaccggtgctcgatttagtatctgatagttgggtttgggtgcccaagctgctggggggcagggtcaccatgaccagggacacgtccatcagtacagcctacatggagctgagcagtctgagacctgacgacacggccgtgtattattgtgcgttagttacggacgattacgacgttttgattggtcattacccggagtgtggggcaaagggccacggtcaccgtctcctcagcctccaccaagggcccatcggtcttccccctggccaccctctccaagagcacctctggggcacgagccggccctgggctgcctggtcaaggactacttcctacgtgagctctgagcgggctggcaaggcnatagnnnnnnnnnnnn

SEQ ID NO: 280018 - DNA, 531 bp, Homo sapiens
  misc_feature: GYAE6OF01CNYAW.47.38.D05.1.454.CMB.1.raw
  modified_base (512)..(531): a, c, t, g, unknown or other
  misc_feature (512)..(531): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtctattacccggacgtggtggggcaaagggaccacggtcaccgtctcctcacgcctccaccaagggcccacgtccgggtccttcccccgtggcctaccctcctccaacgacgccacctcgtcggggcacgacgccggccctggacctcgccctggtacaacgggtaccttacgttccctacgtgacgtcctctggacggcgggtcgtcggcgaacgggcgacagtacgnnnnnnnnnnnnnnnnnnnn

SEQ ID NO: 280019 - DNA, 360 bp, Homo sapiens
  misc_feature: GYAE6OF01BT7RV.47.38.D05.1.454.CMB.1.raw
  modified_base (275)..(275): a, c, t, g, unknown or other
  misc_feature (275)..(275): n is a, c, g, or t
  modified_base (354)..(360): a, c, t, g, unknown or other
  misc_feature (354)..(360): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtgggcaaagggaccacggtcaccgtctcctcagcctccaccaagggcccatcggtccttcccctggccaccctcctccaagagcacctcgngggggcacagcggccctgggctgcctggtcaaggactacttcctacgtgagctctgagcgggctggcaaggcgcatagnnnnnnn

SEQ ID NO: 280020 - DNA, 388 bp, Homo sapiens
  misc_feature: GYAE6OF01A4BP1.47.38.D05.1.454.CMB.1.raw
  modified_base (382)..(388): a, c, t, g, unknown or other
  misc_feature (382)..(388): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggccacggtcaccgtctcctcagcctccaccaagggcccatcggtcttccccctggcaccctcctccaagagcacctctgggggcacagcggccctgggctgcctggtcaaggctactcctacgtgagctctgagcgggctggcaaggcgcatagnnnnnnn

SEQ ID NO: 280021 - DNA, 506 bp, Homo sapiens
  misc_feature: GYAE6OF01DNTWT.47.38.D05.1.454.CMB.1.raw
  modified_base (492)..(492): a, c, t, g, unknown or other
  misc_feature (492)..(492): n is a, c, g, or t
  modified_base (496)..(506): a, c, t, g, unknown or other
  misc_feature (496)..(506): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgtattacgacgttttgattggtcattacccggacgtggtggggcgaaagggaccacggtcaccgtctcctcacgcctccaccgaaggcccagtccggtccttccccctggccaccctcctccaacgacgccacctcgtcgggggcacgacggccggcccgtcggggctcggccgtcggtacgaaggtaccttacttccgtacgtgacgtctctgagcgggctggcaggcncatnnnnnnnnnnn

SEQ ID NO: 280022 - DNA, 388 bp, Homo sapiens
  misc_feature: GYAE6OF01AJ0CD.47.38.D05.1.454.CMB.1.raw
  modified_base (383)..(388): a, c, t, g, unknown or other
  misc_feature (383)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggaccacggtcaccgtctcctcagcctccaccaagggcccatcggtcttccccctggccaccctcctccaagagcacctctgggggcacagcggcctgggctgcctggtcaaggctacttcacgtgagctctgagcgggctggcaggcgcatagnnnnnn

SEQ ID NO: 280023 - DNA, 501 bp, Homo sapiens
  misc_feature: GYAE6OF01C1C0B.47.38.D05.1.454.CMB.1.raw
  modified_base (431)..(431): a, c, t, g, unknown or other
  misc_feature (431)..(431): n is a, c, g, or t
  modified_base (473)..(501): a, c, t, g, unknown or other
  misc_feature (473)..(501): n is a, c, g, or t
tcagagctcacgtacacgaccggtgctcgatttagtatctgatagttgggtttgggtgcccaagctgctgggagggcagggtcaccatgaccagggacacgtccatcagtacacgcctacagtggagctggagcagtctgacgacctgacgacacggccgtgtattattgtgtcgttagtacggacgtattacgtacgttttgattggctacgttacccggacgtgggtggggacgaaagggaccacggtccacccgtctcctcacgccctaccaaccgaacgggcccagtccggtccttcccccgtggaccctacccctcctaccaagacgcctaccgtcggtcgggggccaaccgaggcccggcccgtgggtccgtcgtccgtcggtacgaaacggtaccttaccgttaccgtacgtgacgtccttcgnggacgggccgggtacgtcggacgaacgggccgacgtataggnnnnnnnnnnnnnnnnnnnnnnnnnnnnn

SEQ ID NO: 280024 - DNA, 363 bp, Homo sapiens
  misc_feature: GYAE6OF01CJ861.47.38.D05.1.454.CMB.1.raw
  modified_base (353)..(363): a, c, t, g, unknown or other
  misc_feature (353)..(363): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttcccctggcaccctcctccaagacgcacctctgggggcacagcggccctgggctgcctggtcaaggcctacttcctacgtgagctctgaggcgggctggcaaggcgcatagnnnnnnnnnnn

SEQ ID NO: 280025 - DNA, 733 bp, Homo sapiens
  misc_feature: GYAE6OF01DEA02.47.38.D05.1.454.CMB.1.raw
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
tcagagctcacgtacacgaccggtgctcgatttagtatctgatagttgggtttggggtgatcaggactcctcagttcaccttctcacaatgaggctccctgctcagctcctgggctgctatgctctgggtctctggatccagtgggatatgtgatgactcagtcctccacctcctccctcgcccgtcacccgtggacgcgcccgcctccatctcctgctagtctacgcagctctactanatagtaatgattacaattattgaattgacnganacgagcgaggctacgtcctcgactagccgtttactgtacgtttcggtttggtttaccggttcgtacggccggttcccgggtccccggttacggggtcccttaggacgtttacgggtacggtaacggcggttacgaacgggtttcgaaccttacggaaccgtaacgtaacgttaacgttttaacgtttaacggacgttaaaacggtaaacggttacgggttaagggtacgggggtaggtacgggttaggtagggttagggtttagggttttacggggtttaacgttttactacgtcggtaactaggttaacccgtagttaaaccgttaccgttaaaccttaccggttaccgtttaacgggttaccggtttaacgggacccggtaaaacgggtaacctacgggtaacgtaaggaactaaaacgtacgtaacggtacgtcgttaagctaaaccgtcctaaccgg

SEQ ID NO: 280026 - DNA, 483 bp, Homo sapiens
  misc_feature: GYAE6OF01ASFTV.47.38.D05.1.454.CMB.1.raw
  modified_base (472)..(483): a, c, t, g, unknown or other
  misc_feature (472)..(483): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcaggggcaggggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtctccccctggcacccctcctccaacgagcacctcgtggggcacagcgccctgggctgcctggtcaaggactacttcctacgtcgagctctgagcgggctggcaaggcgcatagcnnnnnnnnnnnn

SEQ ID NO: 280027 - DNA, 390 bp, Homo sapiens
  misc_feature: GYAE6OF01CQWJD.47.38.D05.1.454.CMB.1.raw
  modified_base (361)..(361): a, c, t, g, unknown or other
  misc_feature (361)..(361): n is a, c, g, or t
  modified_base (385)..(390): a, c, t, g, unknown or other
  misc_feature (385)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggccgccctgctccaggacgcacctccgagacgcacagcggccctgggctgcctggtcaaggctactctacgtgagctcngagcgggctggcaaggcgcatagnnnnnn

SEQ ID NO: 280028 - DNA, 582 bp, Homo sapiens
  misc_feature: GYAE6OF01B8871.47.38.D05.1.454.CMB.1.raw
  modified_base (178)..(180): a, c, t, g, unknown or other
  misc_feature (178)..(180): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (186)..(188): a, c, t, g, unknown or other
  misc_feature (186)..(188): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (208)..(211): a, c, t, g, unknown or other
  misc_feature (208)..(211): n is a, c, g, or t
  modified_base (213)..(216): a, c, t, g, unknown or other
  misc_feature (213)..(216): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (235)..(236): a, c, t, g, unknown or other
  misc_feature (235)..(236): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (249)..(251): a, c, t, g, unknown or other
  misc_feature (249)..(251): n is a, c, g, or t
  modified_base (253)..(254): a, c, t, g, unknown or other
  misc_feature (253)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
tcagagctcacgtacacgaccggtgctcgattttagtatctgatagttgggggtttgggggaagagggaagactggacggtcccccaggagttcaggtggctggcacagcggccctggcctgcctgcaacgctacttctacgtgagctctgagcgggctcggccaaaggcgacatagnnncncngnnncgccngacaacgcagntncnnnngnnnntnanaanatntntntgtcnnanangngcncgcnnngnncngngngcgngcgacacncgcgcgcngagagctcnctcncncgacgcgacgacgacgacgcgcgtacgtacgtactacgtacgacggtcggtacggtaggtacggtacgtagacgaacgtacgtacgtacgtacgttacgtacgtacgtacgtaacgaacgtacgtacgttacgtacgtacggtacggtacggtagggttacgggtacgggtacgggtaacggtaccggttacggtaccggtaccggttaccggttaccggtaccggtaccggtaccggtaccgtcccgtaccccgtcccgtacccggttccgtccgtcccggtcccg

SEQ ID NO: 280029 - DNA, 503 bp, Homo sapiens
  misc_feature: GYAE6OF01DISEL.47.38.D05.1.454.CMB.1.raw
  modified_base (465)..(465): a, c, t, g, unknown or other
  misc_feature (465)..(465): n is a, c, g, or t
  modified_base (492)..(503): a, c, t, g, unknown or other
  misc_feature (492)..(503): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggcgtgtattatgtgcgtagtacggacgattacgacgttttgattggtcattacccggacgtgtggggcaaagggaccacggtcaccgtctcctcacgcctccaccaacggcccagtccggtccttcccctcggccaccctcctaccaagacgcacctcgtgggggcacgacgcggcccgtgggctgcctgggtccaagggtacctactttccctatcgtatacgtctagacgngggcctgggccaagggcgacagtacgnnnnnnnnnnnn

SEQ ID NO: 280030 - DNA, 502 bp, Homo sapiens
  misc_feature: GYAE6OF01BDB9X.47.38.D05.1.454.CMB.1.raw
  modified_base (316)..(316): a, c, t, g, unknown or other
  misc_feature (316)..(316): n is a, c, g, or t
  modified_base (497)..(497): a, c, t, g, unknown or other
  misc_feature (497)..(497): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatctatttgctttaancggcctccggggtccctgacagttcactggcagtggatcaggcacagtattttacattgaaatcgagcagagtaggagctgacgtatgcgtggtatttatactgcatgactaagtactaaacaacttccttacaccgttcggacaggaccacgactaggactatacgacactgcgactgcnctacg

SEQ ID NO: 280031 - DNA, 386 bp, Homo sapiens; identical to SEQ ID NO: 279935
  misc_feature: GYAE6OF01E58UZ.47.38.D05.1.454.CMB.1.raw
  modified_base (384)..(386): a, c, t, g, unknown or other
  misc_feature (384)..(386): n is a, c, g, or t

SEQ ID NO: 280032 - DNA, 390 bp, Homo sapiens
  misc_feature: GYAE6OF01BMD40.47.38.D05.1.454.CMB.1.raw
  modified_base (379)..(379): a, c, t, g, unknown or other
  misc_feature (379)..(379): n is a, c, g, or t
  modified_base (384)..(390): a, c, t, g, unknown or other
  misc_feature (384)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcggctggcaaggcgnatagnnnnnnn

SEQ ID NO: 280033 - DNA, 368 bp, Homo sapiens
  misc_feature: GYAE6OF01DPLKJ.47.38.D05.1.454.CMB.1.raw
  modified_base (361)..(368): a, c, t, g, unknown or other
  misc_feature (361)..(368): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagccacctctgggggcacagcggccctgggctgcctggtcaaggactacttcctagtgagctctgagcgggctggcaaggcgcatagnnnnnnnn

SEQ ID NO: 280034 - DNA, 642 bp, Homo sapiens
  misc_feature: GYAE6OF01C614U.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccagtcctccctgcccgtcacccctggagacgcccggcctccatcctcctgcaggtctagccagacgcctcttacatagtaatggtattcaacttattagaattggtacctgacagaagcgtagggcagtctccacagcctcctgtacttcgttggttttcgggttctggacgttccggggtcccgttcccgggggtccctggacgtacgggttcgaggtggcgtaggtggactccgaggctaacgtagttaacgttttacgacttaagtaaaagtcgtaagggtagggtagggaggtacgtaggagggtagtttgggtttagggtttattacgtgtactagtacggtacgtaagtttacctaaaccgttaaccttaccttaacgttacgtttacgggaccggtacgggtaaccaggtcgtagggaacgtataacgaaacgtacgtggtacgtcgtacgacctacctagttcgttacg

SEQ ID NO: 280035 - DNA, 389 bp, Homo sapiens
  misc_feature: GYAE6OF01DM773.47.38.D05.1.454.CMB.1.raw
  modified_base (384)..(389): a, c, t, g, unknown or other
  misc_feature (384)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaaggccatcggtcttccccctggccaccctcctccaagagcacctctgggggcacagcggccctgggctgcctggtcaaggactactcctacgtgagctctgagcgggctggcaaggcgcatagnnnnnn

SEQ ID NO: 280036 - DNA, 404 bp, Homo sapiens
  misc_feature: GYAE6OF01CRPS4.47.38.D05.1.454.CMB.1.raw
  modified_base (395)..(404): a, c, t, g, unknown or other
  misc_feature (395)..(404): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagccctccaccaagggcccatccggtcttccccctggccaccctcctccaacgacgcacctcgtgggggcacgagcggcccgtggctgcctggtcaaggtactacttcctacgtgacgctctgagcgggctggcgaaggcgcatagnnnnnnnnnn

SEQ ID NO: 280037 - DNA, 354 bp, Homo sapiens
  misc_feature: GYAE6OF01CBRUT.47.38.D05.1.454.CMB.1.raw
  modified_base (352)..(354): a, c, t, g, unknown or other
  misc_feature (352)..(354): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggactacttcctacgtgagctctgagcgggctggcaaggcgcatagnnn

SEQ ID NO: 280038 - DNA, 581 bp, Homo sapiens
  misc_feature: GYAE6OF01B832G.47.38.D05.1.454.CMB.1.raw
  modified_base (435)..(435): a, c, t, g, unknown or other
  misc_feature (435)..(435): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagccagagcctcttacatagtaatggattcaaacttatttgaattggtacctgcagaagccgagggcagtctccacagctcctgatcgttggtttgggttctggacgtccgggcccgtcccgggggtccctggacgtaggtttcaggtcggctaggtggatcgaggcacgagtagttttacgactagtaaaatcgaggtagggtggaggngtaggaggtagttgggtttaggggtttattacgtgacgtatggtactaagttacctaaactaaccttaccttaacgttacgtttcggaccgtaacgggaccgtaagtcgtaggagacgtacgaaacgtactggtaggctgctaacc

SEQ ID NO: 280039 - DNA, 365 bp, Homo sapiens
  misc_feature: GYAE6OF01AV05O.47.38.D05.1.454.CMB.1.raw
  modified_base (361)..(365): a, c, t, g, unknown or other
  misc_feature (361)..(365): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgcctggtcaaggactacttcctacgtgagctctgagcgggctggcaaggcgcatagnnnnn

SEQ ID NO: 280040 - DNA, 609 bp, Homo sapiens
  misc_feature: GYAE6OF01C3TVY.47.38.D05.1.454.CMB.1.raw
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagagctcacgtacacgaccggtgctcgatttagtatctgatagttgggtttgggtgcccaagctcgctggagggcacggtcaccacgctgcttgagtggatgggacggatcagccctaacagtggtggcacaaactatgcacagtaggtttcagggcagggtcaccatgaccagggacacgtccatcagtacagcctacgatggagctgagcagtctgacgacctgacgacacggccgtgtattattgtgcgttagtacggactattacgtacgttttgattggtctagttacccggacggtggtaggggcaaagggaccgacggtccaccgtctcctcacgcctaccaccgaagggcccagtccggtccttccccgtcggcctaccctcctaccaacgacgaccaccgtcgtcggggcacgacgcccggcccgtcgggctcggacccgttcggtaccgaaacggtaccttacctttaccgtaccgttcgaacgtccgttacgtcgacgggtccgggtccgtcgggaccggaaacggggtccggacgtaacggttaacggcgngngngngngcgtcgngngcgagagacgtacgtagtgngngngcg

SEQ ID NO: 280041 - DNA, 554 bp, Homo sapiens
  misc_feature: GYAE6OF01BF98W.47.38.D05.1.454.CMB.1.raw
  modified_base (533)..(533): a, c, t, g, unknown or other
  misc_feature (533)..(533): n is a, c, g, or t
  modified_base (535)..(554): a, c, t, g, unknown or other
  misc_feature (535)..(554): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgtattacgtacgttttgattggtcagttacccggagtgtggggcaaacgggaccacggtccaccggtctcctcacgcctccaccgaacggcccaatccggtccttccccctcggcccacccctccctaccaacgacgccacctcgtcgggggcacgacgccggcccgtgggcctcggcccgtgggtaccgaaacgggtaccttacctttcccgtacggtgaacgccttcgtcggaggcggggctgggaccaaggggtccgacgacgtaggngnnnnnnnnnnnnnnnnnnnn

SEQ ID NO: 280042 - DNA, 361 bp, Homo sapiens
  misc_feature: GYAE6OF01AXKZO.47.38.D05.1.454.CMB.1.raw
  modified_base (352)..(361): a, c, t, g, unknown or other
  misc_feature (352)..(361): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnnnnnnnnn

SEQ ID NO: 280043 - DNA, 362 bp, Homo sapiens
  misc_feature: GYAE6OF01DZSRK.47.38.D05.1.454.CMB.1.raw
  modified_base (356)..(362): a, c, t, g, unknown or other
  misc_feature (356)..(362): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatccggtccttccccctggccacccctcctccaagagcacctctgggggcacagcggccctggctgcctggtcaaggactacttcctacgtgagctctgagcgggctggcaaggccgcatagnnnnnnn

SEQ ID NO: 280044 - DNA, 369 bp, Homo sapiens
  misc_feature: GYAE6OF01CDDU2.47.38.D05.1.454.CMB.1.raw
  modified_base (359)..(369): a, c, t, g, unknown or other
  misc_feature (359)..(369): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctgcaccctctccaagagcacctcgtgggggcacagcggccctgggctgcctggtcaaggactacttcctacgtgagctctgagcgggctgggcaaggcgcatagnnnnnnnnnnn

SEQ ID NO: 280045 - DNA, 358 bp, Homo sapiens
  misc_feature: GYAE6OF01BGIBK.47.38.D05.1.454.CMB.1.raw
  modified_base (354)..(358): a, c, t, g, unknown or other
  misc_feature (354)..(358): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggcaccctcctccaagagcacctctgggggcacagcggccctgggctgcctggtcaaggactacttcctacgtgagctctgagcgggctggcaaggcgcatagnnnnn

SEQ ID NO: 280046 - DNA, 361 bp, Homo sapiens
  misc_feature: GYAE6OF01E0NWO.47.38.D05.1.454.CMB.1.raw
  modified_base (358)..(361): a, c, t, g, unknown or other
  misc_feature (358)..(361): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggccacccctcctccaagagcacctcgtgggggcacagccggccctgggctgcctggtcaaggactacttcctacgtgagctctgagcgggctggcaaggcgcatagnnnn

SEQ ID NO: 280047 - DNA, 428 bp, Homo sapiens
  misc_feature: GYAE6OF01BZ1EX.47.38.D05.1.454.CMB.1.raw
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (416)..(428): a, c, t, g, unknown or other
  misc_feature (416)..(428): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggagtgtggggacaaagggccacggtcaccgtctcctcagcctccacgaacgggcccatccggtccttcccccgtggccacccctcctaccaagcnccaccgtcggnggggccacgnggcccggcccgtggcctcgccgtggtacaaggaccttactcgtatgtactactcgtggacgggcggtctcggacaacgggcacagtagnnnnnnnnnnnnn

SEQ ID NO: 280048 - DNA, 392 bp, Homo sapiens
  misc_feature: GYAE6OF01CVTYL.47.38.D05.1.454.CMB.1.raw
  modified_base (386)..(392): a, c, t, g, unknown or other
  misc_feature (386)..(392): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacaattacgacgttttgattggtcattacccggacgtgtggggcaaagggccacggtcaccgtctcctcagcctccaccaagggcccatccggtcttccccctggccaccctcctccaagagcacctctgggggcacagcggccctggctgcctggtcaaggctacttcctacgtgagctctgacgcgggctggcaaggcgcatagnnnnnnn

SEQ ID NO: 280049 - DNA, 365 bp, Homo sapiens; identical to SEQ ID NO: 279926
  misc_feature: GYAE6OF01AGN76.47.38.D05.1.454.CMB.1.raw
  modified_base (360)..(365): a, c, t, g, unknown or other
  misc_feature (360)..(365): n is a, c, g, or t

SEQ ID NO: 280050 - DNA, 654 bp, Homo sapiens
  misc_feature: GYAE6OF01B247D.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagccagacgcctcttacatagtaatggattcaacttatttagaattggtacctgcagaacgccgaggcagtcctaccacagcctcctgacttcgttggttttggttctggacgtccgggtcccgtccggggtccctgacgtaggttcgaggtcggcgtaggtggactacgacggacaactaggttaacgttttacgacgttaagtaaaagtacgtaagggttaggggtagggacggtagtaggagggtagtttgggtttagggtttattacgtcggtactagttcgtacgttaacgttacctaaccttaaaccgtttaccttaaccgttacgtttacggacccggtaaccgggtaaccgacggtacgtacgggtaagtaacgtaaccgtaaacggtaacgttggtacgggtctacgacctacctgttccgttacg

SEQ ID NO: 280051 - DNA, 672 bp, Homo sapiens
  misc_feature: GYAE6OF01DFDKG.47.38.D05.1.454.CMB.1.raw
  modified_base (355)..(355): a, c, t, g, unknown or other
  misc_feature (355)..(355): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcgtggggctggaggtagaagaagcgtggggcctcgagtgaaggtctctgcaaggtcttcgtggatacagtctacaccgactactatttgctacgtgggtcgccggaccgggccctaggacgagggcttggaggtggagtgggacggatcgacgcctaagngtggtaggacaactaaactgtgaacgacgtaggtacggtttcgacggggacgtacggggtacaaccgtaagccggaacgaacgggtacctaccggtaccaagtaccgaacgtacgacgtacctaacgtaggtcggaagtccgtaggaccgtacgtacggttaccgtaacggacccggtaactcgggaaccgaaccggtaccggggttaccgttaggttaacgtttacgtttcggtacgggttaccggtttaagggtacccggtaagttaacgtttacggttacgttttaggacggtttcggtaccgttaaacccggg

SEQ ID NO: 280052 - DNA, 731 bp, Homo sapiens
  misc_feature: GYAE6OF01DORXS.47.38.D05.1.454.CMB.1.raw
tcagagctcacgtacacgaccggtgctcgatttagtatctgatagttgggtttgggtgatcaggactcctcagttcaccttctcacaatgaggctccctgctcagctcctggggctgctaatgctctggcctcccagataccagattgtgacatccagatgacccagtctccatcctcctgtctgcatctggtaggagacacagtccaaccattccacgttcggcccgggcgaaggttcgaacggggtcgtttcgacaaagttgtctttggccgttggttcagcagacaccgagggaacggccctaagcgcctgactactatggtgctatactactttacgacgtaaacggtcgggtaccctaagtacgtaacggttcgacggtcgggacgtaggttacggtcgtagggtaactaggtacgttacctaaacgttccttaacgtaaccgtacgttacgaacggtccgggtccttaggaccgaaccgtacgtaacgtaacgtactttacgtcgttaactaacgtttaactttaccgttacgttacccgtaccgttaagttacgttacgttacgttaccgttaccccgttttacccggtttaccggttacccggttttaccggaaacccgggttaaacgggttaaacccggtaaaggggttaaaccggtaaaacttaaccggaaaaccggtaacgttacgggtaccggtaccgttccggtaccctaaaccccgg

SEQ ID NO: 280053 - DNA, 662 bp, Homo sapiens
  misc_feature: GYAE6OF01EZK41.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggatattgtgatgactcagtctccactctccctgcccgtcacccgtggacgacgccggcctccatctcctgcaggtctagccagacgcctcttacataagtaatggattcaacttatttgaatttggtacctgacaagaacgccgaggggccagtcctaccacacgccttccgtagacttcgtttggttttgggttctggacgttccggggcccgttccggggtaccctaggacgtaggttcagggtcggcgtaggtggactcgacggactaacgtaggttaacgtttacgacttaagtaaacgtcgtaagggttagggtaggacggtgtaggagggtagtttgggtttacgggtttacttacgtgtactagtcgtacgtaacgttaccgtaacttaaaccttccttaacgttacggtttacggaccggtaacggggtacctaaggtacgtacgggaacgtaactaaccggtaaaacgtacgttggtacggtctacgaccaccgttacgttcgttaccg

SEQ ID NO: 280054 - DNA, 567 bp, Homo sapiens
  misc_feature: GYAE6OF01BJ9JD.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtcctccacagctcctgattcgttggttttgggttctgacgttccgggcccgtccgggggtccctgactaggttcaggtggcaggtggatcgaggcacagtatttacgactagaaatcgtaggtagggtggaggcgtggaggtagttggtttagggttttattacgtgctagtgtactaagttctaactaacgttaccttactacgtttcggaccgtacggggacctaacggtcgtagggacgaactaccgaaacgtaacgtgtaggtctgcctacccg

SEQ ID NO: 280055 - DNA, 485 bp, Homo sapiens
  misc_feature: GYAE6OF01BWGH1.47.38.D05.1.454.CMB.1.raw
  modified_base (474)..(485): a, c, t, g, unknown or other
  misc_feature (474)..(485): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtggtggggcaaagggaccacggtcaccgtctcctcagcctccaccaagggcccatcggtcttccccctggccaccctcctccaacgacgccacctcgtcgggggcacacggccggccctgggctgcctggtcaaggctacttctacgtgagctctgagcgggctggcaggcgcatagnnnnnnnnnnnn

SEQ ID NO: 280056 - DNA, 391 bp, Homo sapiens
  misc_feature: GYAE6OF01ASSB0.47.38.D05.1.454.CMB.1.raw
  modified_base (385)..(391): a, c, t, g, unknown or other
  misc_feature (385)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggccgccctgctccaggagcacctccgagagcacagcggccctgggctgcctggtcaaggctacttcctacgtgagctctgagcgggctggcaaggcgcatagnnnnnnn

SEQ ID NO: 280057 - DNA, 412 bp, Homo sapiens
  misc_feature: GYAE6OF01BAH1G.47.38.D05.1.454.CMB.1.raw
  modified_base (398)..(412): a, c, t, g, unknown or other
  misc_feature (398)..(412): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgtacgttttgattggtcagttacccggagtgtggggcaaaggggaccacggtcaccgtctcctcagcctccaccgaagggcccatccggtccttccccctggccaccctcctccaagagcacctctgggggcacgacgccggccctgggctgcctggtcaaggtactacttcctagtgagctctgacgcgggctggcaaggcgcagtacgnnnnnnnnnnnnnnn

SEQ ID NO: 280058 - DNA, 220 bp, Homo sapiens
  misc_feature: GYAE6OF01ET7FC.47.38.D05.1.454.CMB.1.raw
  modified_base (219)..(220): a, c, t, g, unknown or other
  misc_feature (219)..(220): n is a, c, g, or t
tcagagctcacgtacacgaccggtgctcgatttagtatctgatagttgggtggaggctgaggatgttggggtttattactgcatgcaagttctacaaacttcctacacttttggccaggggaccaagctggagatcaaacgaactgtggctgcaccatctgtcttcatcttcccgccatctgatacgtgagctctgagcgggctggcaaggcgcatagnn

SEQ ID NO: 280059 - DNA, 371 bp, Homo sapiens
  misc_feature: GYAE6OF01AZBO5.47.38.D05.1.454.CMB.1.raw
  modified_base (254)..(254): a, c, t, g, unknown or other
  misc_feature (254)..(254): n is a, c, g, or t
  modified_base (357)..(371): a, c, t, g, unknown or other
  misc_feature (357)..(371): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgatttacgacgttttgattggtcattacccggagtgtggggcaaagggccacggtcaccgtctcctcagcctccaccaagggccccagtccgggtccttcccccgnggccacccctcctccaagcgcacctcgtgggggcacagcgcctgggctgcctggtcaggctacttcctacgtgagctctgagcgggctggcaaggcgcatagnnnnnnnnnnnnnnn

SEQ ID NO: 280060 - DNA, 639 bp, Homo sapiens
  misc_feature: GYAE6OF01C8QDE.47.38.D05.1.454.CMB.1.raw
  modified_base (618)..(619): a, c, t, g, unknown or other
  misc_feature (618)..(619): n is a, c, g, or t
  modified_base (621)..(639): a, c, t, g, unknown or other
  misc_feature (621)..(639): n is a, c, g, or t
tcagagctcacgtacacgaccggtgctcgatttagtatctgatagttgggtttgggtgcccaagctgctggagggcacggtcaccacgctgcttgagtggatggggacggatcagcccctaacagtggtggcacaaactatgcacagaggtttcagggcagggtcaccatgaccagggacacgtccatcagtacagcctaacatggagctgagccagtctagacgacctggaccgacgacggccgtgttattattgtgtacgttagtacggacgtattacggtacgttttgagttggtctagttacccggacggtggtaggggacgtaaaagggacccgacgggtccaccggtcctcctcacgccctaccgaccgaacgggccctagtacccggtccctttaccccccgcggaccctaccccttccctaccgaacgacgacccgacccttcggtacgggggccacggacggtacccgggcccccgtggggtccgtccggtcccgttacgggtacgaaaccgggtaccttacccgtttacccgttaccggtttggaaccttccgtacgtcggacgggccgggtacgtacggggaccgtaacggggccacgaacgtaggnngnnnnnnnnnnnnnnnnnnn

SEQ ID NO: 280061 - DNA, 639 bp, Homo sapiens
  misc_feature: GYAE6OF01AUCEW.47.38.D05.1.454.CMB.1.raw
  modified_base (418)..(418): a, c, t, g, unknown or other
  misc_feature (418)..(418): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagccagacgcctcttacatagtaatggattacaacttatttgaattggtacctgacagaacgccgaggcagtctccacacgctctgtattcgttggttttgggttctacggtacgttccggggcccgttcccgggggtccctaggtaccgtagggttcgaggtgggctaggtggactcgaggcagtagttatttacgngtaagaaagtcgtaaggtagggtaggaggtcgtaggaggtagttggtttagggtttacttacgtagtactagtagtacgtaacgttacctaaacttaaacctttaccgttaacttacggttttaccggaccgtaacggggtaacctaaggtaccgtaggtaacgtaagtaaccgaaaacggtacgtaggtcggtacgttacgacctactagttcgttaccg

SEQ ID NO: 280062 - DNA, 597 bp, Homo sapiens
  misc_feature: GYAE6OF01BTISS.47.38.D05.1.454.CMB.1.raw
  modified_base (205)..(205): a, c, t, g, unknown or other
  misc_feature (205)..(205): n is a, c, g, or t
  modified_base (580)..(597): a, c, t, g, unknown or other
  misc_feature (580)..(597): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatgganctgagcagtctgagacctgacgacacggccgtgtattattgtgcgtttagttacggacgtattacgtacgttttgattggtctagttacccggagtggtggggacaaagggaccgacggtccaccggtcctcctcacgcctccgaaccgaacgggacccacgtccggtccctttacccccgtcggcccacccctccctaccgaacgacgcccgaacccgttccggacgggggtccaccgaccggccggtccccgtcggggtcctacgggtcccgttacgggtaccgaacggtacccgttaccgtttacccgttacggttcgacgtccgtcgtcgggacggcgggccgtcgggacgacgggcgacgtagtaggcannnnnnnnnnnnnnnnnn

SEQ ID NO: 280063 - DNA, 604 bp, Homo sapiens
  misc_feature: GYAE6OF01DBNTK.47.38.D05.1.454.CMB.1.raw
  modified_base (187)..(187): a, c, t, g, unknown or other
  misc_feature (187)..(187): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccagtctccctgcccgtnatcgtggagagccggcctccatctcctgcaggtctagccagacgcctcctgcagaactaataggaaactaccttatttggattggtacctgacaaaagccgagggcagtcctccacacgctcctgattcgttgtttgggttctgacgtccgggtcccgttcccggggtccctgacgtaggttcaggttggcgtaggtggatcgaggcaacgtagtactttacgctaagaaagtcgaagggtagggtgggaggtcgtaggagggtagtttgggttttaggggtttaacttacgtgactagtcgtactaacgttactaactaacctttcctaacttacgtttcggaccgtaacgggaaccgtaacggtcgtaggacgtaactaaccgaaaacgtacgtaggtaggtcgtcgtctaaccg

SEQ ID NO: 280064 - DNA, 394 bp, Homo sapiens
  misc_feature: GYAE6OF01BV0SG.47.38.D05.1.454.CMB.1.raw
  modified_base (389)..(394): a, c, t, g, unknown or other
  misc_feature (389)..(394): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggagtgtggggcaaagggccacggtcaccgtctcctcagcctccaccaagggcccatcggtccttccccctcggccaccctcctccaagacgccacctctgggggcacgagcggccctgggctgcctggtcaaggactacttcctacgtgagctctgagcgggctggcaggcgcatagnnnnnn

SEQ ID NO: 280065 - DNA, 390 bp, Homo sapiens
  misc_feature: GYAE6OF01EKFTN.47.38.D05.1.454.CMB.1.raw
  modified_base (324)..(324): a, c, t, g, unknown or other
  misc_feature (324)..(324): n is a, c, g, or t
  modified_base (349)..(349): a, c, t, g, unknown or other
  misc_feature (349)..(349): n is a, c, g, or t
  modified_base (387)..(390): a, c, t, g, unknown or other
  misc_feature (387)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggcccngggctgccctggtcaagggactacncctacgtgagctctgagcgggctggcaaggcgcatagnnnn

SEQ ID NO: 280066 - DNA, 394 bp, Homo sapiens
  misc_feature: GYAE6OF01DOGDP.47.38.D05.1.454.CMB.1.raw
  modified_base (385)..(394): a, c, t, g, unknown or other
  misc_feature (385)..(394): n is a, c, g, or t
tcagagctcacgtacacgaccggtgctcgatttagtatctgatagttgggtttgggtgcccaagctgctggaggacacggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggccatcggtcttccccctggccaccctcctccaagacgcacctctgggggcacagcggccctgggctgcctggtcaaggactactcctacgtgagctctgagcggctggcaaggcgcatagnnnnnnnnnn

SEQ ID NO: 280067 - DNA, 403 bp, Homo sapiens
  misc_feature: GYAE6OF01ETGIY.47.38.D05.1.454.CMB.1.raw
  modified_base (393)..(403): a, c, t, g, unknown or other
  misc_feature (393)..(403): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaaggcccatcggtccttcccctggccaccctcctccaagacgcacctcgtcgggggcacgacgcggccctgggctgcctggtcaaggactacttcctacgtgagctctggagcgggctggcgaaggcgcgatagnnnnnnnnnnn

SEQ ID NO: 280068 - DNA, 571 bp, Homo sapiens
  misc_feature: GYAE6OF01A4DPO.47.38.D05.1.454.CMB.1.raw
  modified_base (356)..(356): a, c, t, g, unknown or other
  misc_feature (356)..(356): n is a, c, g, or t
  modified_base (436)..(436): a, c, t, g, unknown or other
  misc_feature (436)..(436): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcgtggggctgaggtgaagaagccgtggggcctcagtgaaggtctcctgcaggcttctggatacagcttcaccgactactatttgcactgggtgcgacgggcccctggacaagggctgagtggatgggacgatcacgcctaacgaggtggtggcacaaactntgcacgagtaggtttcgagggcagggtcacgagtcgaccgagggaccacggtaccagtcaagtacagacctacagtggancgtgagctagtctaggacgtacctaggaccgacgaccggtccggttagttacgttagttcggttggtacggtttacggttaacgggtacgttaacgtttaccggtacgtttttaggatttcgggtcttaaccggg

SEQ ID NO: 280069 - DNA, 545 bp, Homo sapiens
  misc_feature: GYAE6OF01AYV8C.47.38.D05.1.454.CMB.1.raw
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (499)..(545): a, c, t, g, unknown or other
  misc_feature (499)..(545): n is a, c, g, or t
tcagagctcacgtacacgaccggtgctcgatttagtatctgatagtttggggtttggggtgcccaagctgctggagggcaggatcaccatgaccagggacacgtccatcagtacagcctacatggagctgagcagtctgagacctgacgacacggccgtgtattattgtgcgttagttacggacgtattacgcgtttttgattggtcagtttaccccggagtggtggggacaaaagggcccacggtccaccgttctcctcacgcccctaccaacccgaacggggccccaagttccgggttcctttcccccccgtggggcccaccccctcctccaaacgcgaccaacccgtcgtcgggggggaccacgacggccggggcccgtgggcctcggcccgtggtaccgaaacgggtaccttaccgtttacccgtaaccgttggaacgccttacgtggaggcggggctgggaccgaagggccgaccaagtaganacgntacgnannnnnnnnnnnnnnnnnnnnnnnnnnnnnnnnnnnnnnnnnnnnnnn

SEQ ID NO: 280070 - DNA, 438 bp, Homo sapiens
  misc_feature: GYAE6OF01C4KK8.47.38.D05.1.454.CMB.1.raw
  modified_base (427)..(438): a, c, t, g, unknown or other
  misc_feature (427)..(438): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgtcgttagttacggacgattacgtacgttttgattggtcagttacccggagtggtggggacaaagggccacggtcaccgtctcctcacgcctccaccaagggcccatccggtccttccccctggccaccctccctaccaagacgccaccgtcggtcgggggccacgacggcccggcccgtgggcctgcccgtggtaccaacggtaccttaccgttcctacgtgacgtctcgtggacggcgggctggcgaaggcacagtagnnnnnnnnnnnn

SEQ ID NO: 280071 - DNA, 373 bp, Homo sapiens
  misc_feature: GYAE6OF01CFOHL.47.38.D05.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (365)..(373): a, c, t, g, unknown or other
  misc_feature (365)..(373): n is a, c, g, or t
tcagagctcacgtacacgaccggtgctcgatttagtatctgatagttgggtttgggtgcccaagctgctcggagggcacggtcaccacgctgctgagcagtctgagacctgacgacacggccgtgtattattgtgcgtttagttacggacgattacgacgtttttgattggtcatttacccggacgtgtggggcaaagggaccacggtcaccgtctcctcagcctccaccaagggccccagtccggtccttcccccctggccacccctcctccaagacgcacctcgtggggcacagccggccctgggctgccctggtcaaggactacttcctacgtgagctcngagcggctggcaaggcnatagnnnnnnnnn

SEQ ID NO: 280072 - DNA, 608 bp, Homo sapiens
  misc_feature: GYAE6OF01DSJZF.47.38.D05.1.454.CMB.1.raw
  modified_base (590)..(608): a, c, t, g, unknown or other
  misc_feature (590)..(608): n is a, c, g, or t
tcagagctcacgtacacgaccggtgctcgatttagtatctgatagttggggtttgggtgcccaagctgctggagggcacggtcaccacgctgcttgagtggatggggacggatcagccctaacagtggtggcacaaactatgcacagaggtttcagggcagggtcaccatgaccgagggacacgtccatcagtacagcctacatggagctgagcagtctgagacctgaccgacacggccgttgtattattgtgtcgttagttacggacgtattacgtacgttttgattggtctacgtttaccccggacggttggtcggggacgaaaacggggaccgacggtcgacccggtctcctcgacgccctccaccgaacggcccactccggttccttcccccgtcggacctcccctacctaccaagacgtccaccgtcggtacggggccaacgacggcccgggcccgtacggggtctcggtcccgtacgggtaacgtaacgggtacccttaccgttcccggttaacgtcggtaacgtcccttcggtacggaacgggtccggggtctacgggaccgtaagggtccgactacgtagcnnnnnnnnnnnnnnnnnnn

SEQ ID NO: 280073 - DNA, 717 bp, Homo sapiens
  misc_feature: GYAE6OF01AEDIW.47.38.D05.1.454.CMB.1.raw
  modified_base (385)..(385): a, c, t, g, unknown or other
  misc_feature (385)..(385): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgcccggcctccatcctcctgcaggtctagccagagcctctacatagtaatgattcaactatttgattggtacctgcagaagccagggcagtctccacagctcctgatctggtttgggttctgagtcgggccgtccgggggtccctgacgtaggttcaggtggcaggtggatcgaggcacgagtatttacgntagaaatcgtaggttagggtgggaggtcgtaggagggtagtttgggtttaggggttttattacgttgcgtagttacggtacgttaaacggtttaccttaaacgttaaaacccttttacccgtttaaccctttaaccggttttttaccggggaaccccggtaaacccggggggggtaacccttaaaacggggtacccggttaacgggggtaaacgtaaaccggtttaaacccggtaaaaaacccgggtaaaccgggtttaacgggttacggggtacccggtttaacccgggacccgtaaacccccggttaacgtttcccgtttttaacccggg

SEQ ID NO: 280074 - DNA, 617 bp, Homo sapiens
  misc_feature: GYAE6OF01CGSHN.47.38.D05.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagagctcacgtacacgaccggtgctcgatttagtatctgatagttgggtttggggaggactcctcagttcaccttctcacaatgaggctccctgctcagctccgtggggctgctaatgctcgtgggtctctggatccaggtgggatattgtgatgactcagtctccactctccctgcccgtcacccgtggacgacgccggcctccatcctccgtgcaggtctagccagactcctacttacatagtaatggattacaattattgaaattggtaccngcaaggaacgccgtagggcagtctaccanagctcgtgatcgttggtttgggtctggacgtccgggccttccggggtcctagacgtaggttcaggtggactaggtggatcgaaggcaacgtagttatttacgactaagaaaagtcgtaagggtagggtaggacggtagtggtaaggtaggtttgggtttagggtttaatacgtgactagcggtaactaagttactaaactaacctttcctaacgttacgtttcggaccggtaacgggaaccaggtcgtaggaactaagtaaccgtaaaacggtaacgtggtacggtctacgaccaaccctgttccgttacg

SEQ ID NO: 280075 - DNA, 548 bp, Homo sapiens
  misc_feature: GYAE6OF01C4B1G.47.38.D05.1.454.CMB.1.raw
  modified_base (200)..(200): a, c, t, g, unknown or other
  misc_feature (200)..(200): n is a, c, g, or t
  modified_base (531)..(548): a, c, t, g, unknown or other
  misc_feature (531)..(548): n is a, c, g, or t
tcagagctcacgtacacgaccggtgctcgatttagtatctgatagttgggtttgggtgcccaagctgctggagggcacggtcaccacgctgcttgagtggatgggacggatcagcccctaacagtggtggcacaaactatgcacagaggtttcagggcagggtcaccatgaccagggacacgtccatcagtacagcctanatggagctgagcagtctgagacctgacgacacggccgtgtattattgtgcgttagtacggacgtattacgtacgttttgattggtctacgttacccggacgtggtggggcaaagggaccacggtcaccgtctcctcacgcctccaccacggccactccggtccttcccccgtcggccctaccctcctaccaacgacgccaccgtcggtcgggggaccacgacggccggcccgtgggcctcggccgttcggtacaacgggtaccttaccgttaccgttacgtacgacgtccttcgtggacggcgggcgtggaccgtaagggcgacagtacgnnnnnnnnnnnnnnnnnn

SEQ ID NO: 280076 - DNA, 550 bp, Homo sapiens
  misc_feature: GYAE6OF01A9MYW.47.38.D05.1.454.CMB.1.raw
  modified_base (296)..(296): a, c, t, g, unknown or other
  misc_feature (296)..(296): n is a, c, g, or t
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctgaatccagtggggatattgtgatgactcagtctccactctccctgcccgtcacccctggagagccggcctccatctcctgcaggtctacgccagagcctcttacatagtaatggattcaactatttgaattggtactgcagagccagggcagtctccacngctctgatcgtgtttgggttctgagtccggccttccggggtccctgacgaggttcgagtggcagtggatcgaggcanagtatttcgatagaaatcgaaggtagggtggagtcgtggaggtgttggtttgggtttattacgtgngagtgactaagttctaacgtaactttcctaactacgtttcggacgacggggacctaaggtcgtggaacgtaactacgtaaaacgtacgttacggtgggctcggcctaaccg

SEQ ID NO: 280077 - DNA, 551 bp, Homo sapiens
  misc_feature: GYAE6OF01DMITQ.47.38.D05.1.454.CMB.1.raw
  modified_base (530)..(531): a, c, t, g, unknown or other
  misc_feature (530)..(531): n is a, c, g, or t
  modified_base (533)..(551): a, c, t, g, unknown or other
  misc_feature (533)..(551): n is a, c, g, or t
tcagagctcacgtacacgaccggtgctcgatttagtatctgatagttggggtttgggtgcccaagctgctggagggcacggtcaccacgctgcttgagtggatgggacggatcagcccctaacagtggtggcacaaactatgcacagaggtttcagggcagggtcaccatgaccagggcacgtccatcagtacagcctacatggagctgagcagtctgagacctgacgacgacggccgtgtattattgtgcgttagtacggacgtattacgtacgttttgacttggtctagtttacccggacgttggtgggggacaaagggaccacggtcaccgtctcctcagcctaccaccaaggccacgtccgtaccttcccccgtggccacccctcctacccaacgacgccaccgtcgtcggggcacgacggccggccctggggctggcccgtggtacaaggtaccttacgttccgtacgtgtacgtccttcgtaggacggcgggcgtcgggaccgaagggccgactaagttacggnngnnnnnnnnnnnnnnnnnnn

SEQ ID NO: 280078 - DNA, 564 bp, Homo sapiens
  misc_feature: GYAE6OF01DXH3P.47.38.D05.1.454.CMB.1.raw
  modified_base (182)..(182): a, c, t, g, unknown or other
  misc_feature (182)..(182): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccagtctccctgcccgtnatcgttggagacgccggcctccatcctcctgcaggtctagccagacgcctcctgcagactaatggaaatcctatttggattggtacctgacaaaagccgagggcagtcctaccacaactcctgtatcttaatttggtacttttaagtccgggccgttccgggtccctagacgtaggttcactggcagtggatcaggcacagtatttacattagaaatcgagcagagtggaagtnagacgatcgngtggtatttatctgcatgacaagtactaaactaccgttaccttcgaccgttacggaccgaaggtaccaaccggtacgttacggactaaagttaacggaaccgtaacgttcgggtacgtacgtacgcctaacccgtacg

SEQ ID NO: 280079 - DNA, 681 bp, Homo sapiens
  misc_feature: GYAE6OF01EG8FN.47.38.D05.1.454.CMB.1.raw
tcagagctcacgtacacgaccggtgctcgatttagtatctgataggttggggttggggtgatcaggactcctcagttcaccttctcacaatgaggctccctgctcagctccgtggggctgctaatgctcgtgggtctcgtggatccgaggtgggatattgtgatgactcagtctccactcctccctcgcccgtccaccccgtggacgacgcccgcctccactcctcctgctaggtctacgccagacgtccttacttaacattagtaaagtggtaactttacaaacttatttaggtaatttcggtacctgacgaaggaacgccgagggctacgtcctaccacgacgtcctctgtacttcggtttggttttcgggtctcggtacggtcccgggtcccgttccggggtccctaggacgtaggtcgaggtcgcgtagggtcgattaccggaggactacgtaagttacgtttacgtacgtaaagtaaaagtcggtaagggttaggggtgggaaggtcggtagggtaggttaggtttgggtttagggtttacttacgtgtaactaggtacgtagtaacgtttacctaaccttaaccgttacctacgttacgttacggaccggtaagggaccgtagtcgtaaggtactaacgaactaaacggtacgtggtacggtctcgtcgtaaccg

SEQ ID NO: 280080 - DNA, 506 bp, Homo sapiens
  misc_feature: GYAE6OF01CIUW6.47.38.D05.1.454.CMB.1.raw
  modified_base (495)..(506): a, c, t, g, unknown or other
  misc_feature (495)..(506): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgtattacgtacgttttgattggtctattacccggacgtgtgggcaaagggaccacggtcaccgtctcctcacgcctccaccgaacggcccagtccggtccttcccccgtggcccacccctccctccaacgacgccacctcgtcggggcacgacgccggccctgggctcgcctggtcaaggtcctacttcctacgtcgacgtctcgtgacgcgggcgtggacgagggcgcatgnnnnnnnnnnnn

SEQ ID NO: 280081 - DNA, 361 bp, Homo sapiens
  misc_feature: GYAE6OF01EC19K.47.38.D05.1.454.CMB.1.raw
  modified_base (354)..(361): a, c, t, g, unknown or other
  misc_feature (354)..(361): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagccacctctggggcacagcggccctgggctgcctggtcaaggactacttcctacgtgagctctgagcgggctggcaaggcgcatagnnnnnnnn

SEQ ID NO: 280082 - DNA, 661 bp, Homo sapiens
  misc_feature: GYAE6OF01EIQC2.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccgcctccatctcctgcaggtctagccagacgtcctcttacatagtaatggattcaacttatttgaattggtacctgcagaagccgagggcagtcctaccacacgcctctgtattcgttggttttacgggttctggacgttccgggcccgttcccgggggttcccctaggacgtaggttaccaggttcggcgtaggtggactcgaggaccgtactagttacttttacggaccttaagtaaaacgtcgtaagggttaggggtggagggtcgtaggtaggtagtttagggtttagggttttaattagtgactagtacgtactaacgtttaccttaaacgtaacctttacccttaacgttacgttttacggaccggtaaacggggaccctaaaggtccggtaggaacgtaacgttaacccgaaaacggttaacgttaggtacgggtccttagggcctaaacccg

SEQ ID NO: 280083 - DNA, 646 bp, Homo sapiens
  misc_feature: GYAE6OF01BCGPM.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccgagggcagtctccacagctcctgattcgttggtttgggttctggtacgtccggggtcccgtcccgggggtcccctggaccgtagggttccgaggtcggcgtaggtgggactcgaggccaacgtagttacttttacggctaagtaaaactcgtaagggtaggggtaggagggtcgtaggagggtagttgggtttaggggtttattacgtggtctagtgacgttaacgttacctaacgttaaacctttccgttaacttaccgttttacgggacccgtaagggggtaccctaaagtcggtaggtaacgtaataacccggaaaacggtacgtagggtacggtacgtacggacctaacccgtgttccgttaccg

SEQ ID NO: 280084 - DNA, 358 bp, Homo sapiens
  misc_feature: GYAE6OF01AMWLJ.47.38.D05.1.454.CMB.1.raw
  modified_base (354)..(358): a, c, t, g, unknown or other
  misc_feature (354)..(358): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgcctggtcaaggactacttcctacgtgagctctgagcgggctggcaaggcgcatagnnnnn

SEQ ID NO: 280085 - DNA, 369 bp, Homo sapiens
  misc_feature: GYAE6OF01BQNSL.47.38.D05.1.454.CMB.1.raw
  modified_base (360)..(369): a, c, t, g, unknown or other
  misc_feature (360)..(369): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggccacccctcctccaagacgcacctcgtgggggcacgagccggccctgggcctgcctggtcaaggactacttcctacgtgagctcgtgagcgggctggcaaggcgcatagnnnnnnnnnn

SEQ ID NO: 280086 - DNA, 552 bp, Homo sapiens
  misc_feature: GYAE6OF01BK8IE.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaacttatttgaattggtacctgcagaagccagggcagtctccacagctcctgattctgtttggttctgacgtcgggccgtccggggtcctgactaggttcaggtggcaggtggatcgaggcacgagtatttacgctagaaatcgaggtagggtaggaggtcgtaggaggtagttgggtttaggggttttattacgtgtactagtgactaagttactaacgtaaactttccttacttacgtttcggaccgtagggaccaagcgtaggagatacgaaacgacgtggcgtctacgacactgtcgtcg

SEQ ID NO: 280087 - DNA, 479 bp, Homo sapiens
  misc_feature: GYAE6OF01EF3K6.47.38.D05.1.454.CMB.1.raw
  modified_base (470)..(479): a, c, t, g, unknown or other
  misc_feature (470)..(479): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggtacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattaccccggacgtgtggggcaaaggggaccacggtcaccggtctcctcagcctccaccaaggcccatcggtcttcccctggccaccctcctccagagcacctctggggcacgacgcggccctgggctgccgtggtcaaggctacttcctacgtgagctcgtgacgcgggctggcaggcgcatagnnnnnnnnnn

SEQ ID NO: 280088 - DNA, 616 bp, Homo sapiens
  misc_feature: GYAE6OF01BFJKC.47.38.D05.1.454.CMB.1.raw
  modified_base (305)..(305): a, c, t, g, unknown or other
  misc_feature (305)..(305): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (531)..(531): a, c, t, g, unknown or other
  misc_feature (531)..(531): n is a, c, g, or t
tcagagctcacgtacacgaccggtgctcgatttagtatctgatagttgggtttagggggtgcccaagcctgctggagggcagggtcacctactgtaccagggacacgtccatcagtacagcctacatggagctgagtcgagtctgagaccgttgacgtacacggtccgttagtattattcgtgtcgttagttacggacgattacgacgttttgattggtcagttacccggacgtggtcgggacaaagggccgacggtcaccgtctcctcacgcctccaccaagggcccatccggtacttcccccnggtccaccctcctccaagtacgcctacctcgtgggggccacgtacgccggcccgtgggcctcggcctagggtccaaacgggtacttacgttccgtaacgtacgtacgtctcgtagagtcgggcttagggacaaggctactatacgtnanagctagngacgtctanacactcgtanacggacacactacganacgtntatntactagacgtacacgtacgagtacgngacgtacgtacgtacgacgtacgtacgtacgtacgtagtacgtcgtacgtacgtacgtacgtacgtacgtacgtacgtacgtacg

SEQ ID NO: 280089 - DNA, 575 bp, Homo sapiens
  misc_feature: GYAE6OF01DBLDX.47.38.D05.1.454.CMB.1.raw
  modified_base (200)..(200): a, c, t, g, unknown or other
  misc_feature (200)..(200): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (559)..(559): a, c, t, g, unknown or other
  misc_feature (559)..(559): n is a, c, g, or t
  modified_base (561)..(575): a, c, t, g, unknown or other
  misc_feature (561)..(575): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcaacaaaactatgcacagaggtttcagggcagggtcacatgaccagggacacgtccatcagtacagcctanagtggagctgagcagtctaggacgaccgtgaccgacacgggccgttgttatttagttgtgtacgtttaggttaacggacgtatttacgtacgttttgattggtctaagtttacccgggagttggtggggacaaaaggggaccctacgggtccacccgtctccctcacgtccctaccaacccgaagggtcccacgttccggtcccttcccccgtggcccgtccctagccttccgacggtacgccaccgtccgaggnccaacgngcccggccgtgggctcgccgtggtacgaagtcctacgtttcccgagtcgacgtcgtcgtggaccggtcggaccgtggaccgacggcgtacagtcgangnnnnnnnnnnnnnnn

SEQ ID NO: 280090 - DNA, 121 bp, Homo sapiens
  misc_feature: GYAE6OF01CSTRR.47.38.D05.1.454.CMB.1.raw
  modified_base (115)..(121): a, c, t, g, unknown or other
  misc_feature (115)..(121): n is a, c, g, or t
tcagagctcacgtacacgaccggtgctcgatttagtatctgataggttgggtttgggtgcccaagctgctggagggcagggtcaccatgaccagggacacgtccatcagtacacnnnnnnn

SEQ ID NO: 280091 - DNA, 381 bp, Homo sapiens
  misc_feature: GYAE6OF01CRHLT.47.38.D05.1.454.CMB.1.raw
  modified_base (377)..(381): a, c, t, g, unknown or other
  misc_feature (377)..(381): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggagtgtggggcaaaagggccacggtcaccgtctcctcagcctccacaagggcccatcggtctcccctggcaccctcctccaagagcactctggggcacagcggccctggctgcctggtcaaggactactcctacgtgagctctgagcggctggcaaggcgcatagnnnnn

SEQ ID NO: 280092 - DNA, 373 bp, Homo sapiens
  misc_feature: GYAE6OF01EMR26.47.38.D05.1.454.CMB.1.raw
  modified_base (362)..(373): a, c, t, g, unknown or other
  misc_feature (362)..(373): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggccaccctcctccaagagcacctctgggggcacagcggccctgggctgcctggtcaaggactacttcctacgtgagctctgagcgggctggcaaggcgcatagnnnnnnnnnnnn

SEQ ID NO: 280093 - DNA, 395 bp, Homo sapiens
  misc_feature: GYAE6OF01C6AOQ.47.38.D05.1.454.CMB.1.raw
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
  modified_base (392)..(395): a, c, t, g, unknown or other
  misc_feature (392)..(395): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgtacgttttgattggtcattacccggacgtggtggggcaaagggaccacggtcaccgtctcctcacgcctccaccaacggccatcggtcttcccccnggccaccctcctccaacgagcaccctcgtgggggcacagccggccctgggctgcctggtacaaggctactcctacgtgagctctgagcggactggcaaggcncatagnnnn

SEQ ID NO: 280094 - DNA, 509 bp, Homo sapiens
  misc_feature: GYAE6OF01DYMM8.47.38.D05.1.454.CMB.1.raw
  modified_base (495)..(509): a, c, t, g, unknown or other
  misc_feature (495)..(509): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtggtggggcaaagggaccacggtcaccgtctcctcagcctccaccaaggcccatcggtccttccccctggccaccctcctccgaagacgcacctcgtcgggggcacgacgccggcccgtgggctcgcctcggtacaaggacctacgttcctacgtgacgtctctgaggtccggcgtcggcgaacgggccgacagtacgnnnnnnnnnnnnnnn

SEQ ID NO: 280095 - DNA, 512 bp, Homo sapiens
  misc_feature: GYAE6OF01BXD52.47.38.D05.1.454.CMB.1.raw
  modified_base (487)..(512): a, c, t, g, unknown or other
  misc_feature (487)..(512): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgtcgttagttacggacgtattacgtacgttttgattggtctacgttacccggagtggtggggacaaagggcccacggtccaccgtctcctcacgcctccaccgaacggggcccacgttccggttcccttcccccgtcggcccacccctccctaccaagacgaccacccgtcggtcgggggccaccggacggcccgggtccccggtcggggtccgtcgccgttcgggtacgtaacgggtaccttaccgtttccgtacggtaggacgtccgttcgtggacgggtccggggtcgtacgggacgaacgggccgacgtaagtaggnnnnnnnnnnnnnnnnnnnnnnnnnn

SEQ ID NO: 280096 - DNA, 613 bp, Homo sapiens
  misc_feature: GYAE6OF01BFD9J.47.38.D05.1.454.CMB.1.raw
  modified_base (591)..(592): a, c, t, g, unknown or other
  misc_feature (591)..(592): n is a, c, g, or t
  modified_base (594)..(598): a, c, t, g, unknown or other
  misc_feature (594)..(598): n is a, c, g, or t
  modified_base (600)..(613): a, c, t, g, unknown or other
  misc_feature (600)..(613): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgtcgttagttacggacgtattacgtacgttttgattggtctacgttacccggacgtggtggggacgaaacgggaccgtacggtccaccgtcctccctcgacgccctaccaaccgaacggcccacgtccggtcccttcccccgtcggccctacccctccctaccgaacgacgccgaccgtcggtcgggggaccacggtaccggcccgggtccccgtcggggtcccgtcggtcccgtacgggtaccgaaacggtacccttacccgtttacccgtacggtcgtaccgtaccgtcgtacgggacggtccggggtcgtacgggaccggaagggtccgacgtagtacggnngnnnnngnnnnnnnnnnnnnn

SEQ ID NO: 280097 - DNA, 485 bp, Homo sapiens
  misc_feature: GYAE6OF01EX0KE.47.38.D05.1.454.CMB.1.raw
  modified_base (476)..(485): a, c, t, g, unknown or other
  misc_feature (476)..(485): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtggtggggcaaagggaccacggtcaccgtctcctcagcctccaccacggcccatcggtctccccctggccaccctcctccaagacgcacctcgtgggggcacgagccggccctgggctcgcctggtcaaggactactcctacgtgacgctctggagcgggctgggcgaagggcgcatagnnnnnnnnnn

SEQ ID NO: 280098 - DNA, 840 bp, Homo sapiens
  misc_feature: GYAE6OF01B2MX8.47.38.D05.1.454.CMB.1.raw
tcagagctcacgtacacgaccggtgctcgatttagtatctgatagttgggtttggggaggactcctcagttcaccttctcacaatgaggctccctgctcagctccgtggggctgctaatgctcgtgggtctctggatccaggtggggatattgtgatgactcagtctccactcctccctcgccccgtaccaccccgtggagacgcccggcctccatcctcctgcgaggtctaacgccgaaggacgtccctttacttaacaagttaaggttaaagtggtaactttacgaaactttagtttaggtaagtttcgtaccgtgacgtaaggaacgccggagggccacgtccaccgacacgtcctccgtagtactttcgttggtttggtctggaccggttcccgggccggttccgggtccctaggtacgtggtacgagggtcggtactaggtgtacgtaccgaaggtacctaacggtaacgtttaacgtttaccgaacgttaaacgtaaacgtacgggtaaggggttaggggtaacggacggttacggtagggtaagggtttagggtttttaggggttttaacggggttttaacttacggtacggtacgtaaggtttacgtaacggtttaaaaccggtttacctaaaacccggttttaaaccctttacccggttaaacccgtttttacgggttaccccgggaaacccgggtaaggggtaaaccccgttaggtaaccgggttaaacgggtaaccgtaaaacgttaaacccgggtaaaaccgtagggttaacggttccggtaccgtaaccggtaacccctaacgttttaccggtcccgttttaacccg

SEQ ID NO: 280099 - DNA, 532 bp, Homo sapiens
  misc_feature: GYAE6OF01CBUHH.47.38.D05.1.454.CMB.1.raw
  modified_base (517)..(519): a, c, t, g, unknown or other
  misc_feature (517)..(519): n is a, c, g, or t
  modified_base (521)..(532): a, c, t, g, unknown or other
  misc_feature (521)..(532): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtggtggggcaaagggacccacgggtcaccggtctcctcagcctccaccaagggcccatccggtccttccccctggccacccctcctcccaagacgccaccctcgtcgggggccacgacggccggcccgtggggcctcggccgtgggtccgaaggtaccttacgttccctacggtcgacgccttcgtggacggcggggctgggaccaagggccgacagtagnnngnnnnnnnnnnnn

SEQ ID NO: 280100 - DNA, 378 bp, Homo sapiens
  misc_feature: GYAE6OF01CSTF5.47.38.D05.1.454.CMB.1.raw
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (371)..(378): a, c, t, g, unknown or other
  misc_feature (371)..(378): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattatgtgcgttagttacggacgattacgacgttttgattggtcattacccggacgtgtggggcaaagggaccacggtcaccgtctcctcacgcctcaccaagggccatcggtctcccctggcaccctcctccagacgcactcgtggggcacagcgcctggctgctgtcaaggctactcacgtnagctcngagcggctggcaaggcgcatagnnnnnnnn

SEQ ID NO: 280101 - DNA, 733 bp, Homo sapiens
  misc_feature: GYAE6OF01DY44X.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctgggctgctaatgctctgggtctctggatccgaggtgggatattgtgatgactcagtctccactcctccctcgcccgtccaccccgtggagcgcccgcctccatcctcctgcgagtctacgccagacgtccttacttacattagtaagtgtacttactaacttatttagtaagtttcggtacctgacgtaagacgccgagggtcacgtcctaccacgacgccttacctgtactttcggtttggtttcgggttctggacggtcccgggtcccgttccggggtccctaggtacgtaggttcaggtcggacgtaggtacggacgtcgacgtactaacgtagtttacgtttacgaattaacggtaaaagtcggtaagggttagggtaggacgggtcgttagggtaaggtttacggttttaggggttttaaggtttacttacggtagacgttagtacgtaacgttaacgtttaccgttaaaccgttaaccgttttacctaaccgtttacggtttaccgggaacccgggtaacgggtaacccgtacgggtacgggttaacggtaagtaaccgtaaaccgtaaaacggttacgttacgggttaccggtcgttaccggacccttaacccgg

SEQ ID NO: 280102 - DNA, 569 bp, Homo sapiens
  misc_feature: GYAE6OF01DPSG5.47.38.D05.1.454.CMB.1.raw
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctggaggtgaagaagcctggggccctcgagtgaggtctcctgcaggcttctggatacagcttcaccgactactatttgcactgggtgcgacggccctggacaaggcttgagtgagtgggacgatcgagcctaacgaggtggtaggacaacgaaaactagtgacacgaggtacggtttacgaggggacgagggtcacgatacgacgagggacgacgtacatcgacgtacacgccctagagtcggacgctggaacgcgacgtctggacgaccgtaggaccgacgaccggtcgtcgtagttagttcgtggtacggtttacgttaacgggtacgtagttaccggtacgttttggacgttggttcgtaaccgg

SEQ ID NO: 280103 - DNA, 473 bp, Homo sapiens
  misc_feature: GYAE6OF01ELZ2J.47.38.D05.1.454.CMB.1.raw
  modified_base (462)..(473): a, c, t, g, unknown or other
  misc_feature (462)..(473): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgtacgttttgattggtcagttacccggacgtggtggggcaaagggaccacggtcaccgtctcctcacgcctccaccaacgggcccacttccggtcccttcccccgtcggccacccctccctaccaagacgccaccctcgtcgggggccaccgacggcccgggccccgtggggcctcggtcccgttgggtacaaacgggtaccttaccgtttacccgtacggtcgacgtcttccgtaggacggcggggccgtgggaccgaagggccgcgaagtagnnnnnnnnnnnn

SEQ ID NO: 280104 - DNA, 417 bp, Homo sapiens
  misc_feature: GYAE6OF01EUS70.47.38.D05.1.454.CMB.1.raw
  modified_base (406)..(417): a, c, t, g, unknown or other
  misc_feature (406)..(417): n is a, c, g, or t
tcagagctcacgtacacgaccggtgctcgatttagtatctgatagttgggtttgggtgcccaagctgctgggagggcacggtcaccatgaccagggacacgtccatcagtacagcctacatggagctgagcagtctgagacctgacgacacggcgtgtattatgtgcgttagtacggactattacgacgtttttgattggtcagttaccccgggagtggtgggggacaaaagggcccacggtccaccgtcctcctcagccctacaccgaaggcccatcggtcctcccctgccaccctcctcaagagcacctcgtggggcacgcgcggcccgtggccttcgcctggtacaacggtactaccttcgtacgtgacgctcgtggaggcgggcgtggacgaaggcacatgnnnnnnnnnnnn

SEQ ID NO: 280105 - DNA, 653 bp, Homo sapiens
  misc_feature: GYAE6OF01DH3TH.47.38.D05.1.454.CMB.1.raw
  modified_base (317)..(317): a, c, t, g, unknown or other
  misc_feature (317)..(317): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggatattgtgatgactcagtctccactcctccctcgcccgtcacccgtggagacgcccggcctccatcctcctgcaggtctagccaagacgcctacttaacattagtaaatggtattacaaacttatttgaattggtaacctgacaagaacgccgaagggctagtcctccaacngcctcctgtacttcgttggtttcggtctgacgtccggggccttccggggtcctagaccgtggttccgaggtcggacaggtcggactcgaaggaccaagtaagttactttacgactaagaaatcgtaaggtagggtaggaggtacgtaggtaggtagtttgggtttagggtttattacgtgacgtagtacgtaacgtaacgttacctaacgtaaacctttaccgttaaccgttaacggttttcgggaaccggtaacggggtaaccaaacggtacgtaaggaacgtaactaacgaaacgtaacgtggtacggtcgtacgacctacctagttcgttacg

SEQ ID NO: 280106 - DNA, 580 bp, Homo sapiens
  misc_feature: GYAE6OF01EYMZ8.47.38.D05.1.454.CMB.1.raw
  modified_base (562)..(580): a, c, t, g, unknown or other
  misc_feature (562)..(580): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgacgacctgaccgacgacggtccgtgtattattgtgtcgttagtacggacgtattacgtacgttttgtattcggtctacgttaccggaggtgggtggggacgaaacgggaccgtacggtccaccgtctcctcacgcctaccaccgacggcccacgtccggtcccttccccgcgccacccctccctaccgaacgacgcctacccgtcggtcggggaccaccgacggcccggtcccgtcgggccgtccggtccgttacggacgtaacggtaacccttaccttccgtaacgtcggtacgcctcgtacggacggtcggggtcgtacggacggtacggcgtacgagtagcnnnnnnnnnnnnnnnnnnn

SEQ ID NO: 280107 - DNA, 404 bp, Homo sapiens
  misc_feature: GYAE6OF01CJOYE.47.38.D05.1.454.CMB.1.raw
  modified_base (280)..(280): a, c, t, g, unknown or other
  misc_feature (280)..(280): n is a, c, g, or t
  modified_base (392)..(404): a, c, t, g, unknown or other
  misc_feature (392)..(404): n is a, c, g, or t
tcagagctcacgtacacgaccggtgctcgatttagtatctgatagttgggtttgggtgcccaagctgctggagggcacggtcaccacgctgctgagcagtctgagacctgacgacacggcgtgtattattgtgtcgttagttacggacgtattacgtacgttttgattggtcagttacccggagtggtggggacaaagggccacggtcaccgtctcctcacgcctaccaaccgaaggccccagtccggtcccttccccgtggcccaccctcctacaagcnccacctggtcgggggcaccgacggccggccctggggcctcgcccgtggtcaacggtaccttacttcccgtaggtcgagctacgtgacggcgggctgggcaagggcacatagnnnnnnnnnnnnn

SEQ ID NO: 280108 - DNA, 602 bp, Homo sapiens
  misc_feature: GYAE6OF01DSJHL.47.38.D05.1.454.CMB.1.raw
  modified_base (582)..(582): a, c, t, g, unknown or other
  misc_feature (582)..(582): n is a, c, g, or t
  modified_base (585)..(602): a, c, t, g, unknown or other
  misc_feature (585)..(602): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgtcgttaggttacggacgtattacgtacgttttgattggtctagttacccggacggtggtggggacgaaacgggaccacggtcaccgtctcctcacgcctccaccgaacggcccacgttccggtaccttcccccgcggtcccaccccgttccctacccaacggacgtcccgaaccgtcggtacgggggcctaccgacggcccgggcccgtggggtcctcgggtccccgttagggtaccgaaacgggtacctttaccgtttacccgtacggttacggacgtccgttccgtagggaccggtcggggccgttcgggacgtaacgggcctacgagtagncgnnnnnnnnnnnnnnnnnn

SEQ ID NO: 280109 - DNA, 685 bp, Homo sapiens
  misc_feature: GYAE6OF01CM3HB.47.38.D05.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
  modified_base (499)..(499): a, c, t, g, unknown or other
  misc_feature (499)..(499): n is a, c, g, or t
tcagagctcacgtacacgaccggtgctcgatttagtatctgatagttgggtttggggaggactcctcagttcaccttctcacaatgaggctccctgctcagcctccgtggggctgctaatgctcgtgggtctctggatccgaggtggggatagttgtgatgactcagtctccactcctccctcgcccgtccacccgtggacgacgccgcctccatctcctgctaggtcagccagcnccttatanatagtatgtatacaattattagaagttggtaccngacaagacgccgaggctagtcctaccacacgtctccgtgtattcgtttgggttttcggtctggaccgggttcccgggtccggtttcccggggtaccctagggtaaccgttacgggttcgacgggttaggcgtaagggttcgaccgtcggaacgggcctaaaacgtagtttaacctttaagaatttaaagaaactacgacgagtaaggtacggtagggacgngtacggaactgtacgtaggttacgtttaagttacgtacgtgaactgtacgtaacaacgttaaccctaaacgtacctttaccgtacgtaccggtacggaaaccgaacgggtaacctaacggtacgtaacgaacgtttaaggtaaacggtaccgttaaaggtccggtaacgtccgtaacgtaaccccg

SEQ ID NO: 280110 - DNA, 180 bp, Homo sapiens
  misc_feature: GYAE6OF01A158E.47.38.D05.1.454.CMB.1.raw
  modified_base (173)..(180): a, c, t, g, unknown or other
  misc_feature (173)..(180): n is a, c, g, or t
tcagagctcacgtacacgaccggtgctcgatttagtatctgatagttgggtttgggggaagaggaagactgacggtcccccaggagttcaggtgctggacacagcggccctgggctgcctggtcaaggactacttcctacgtgagctctgagcgggctggcaaggcgcatagnnnnnnnn

SEQ ID NO: 280111 - DNA, 660 bp, Homo sapiens
  misc_feature: GYAE6OF01CVPQU.47.38.D05.1.454.CMB.1.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (516)..(516): a, c, t, g, unknown or other
  misc_feature (516)..(516): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
tcagagctcacgtacacgaccggtgctcgatttagtatctgatagttgggtttggggagactcctcagttcaccttctcacaatgaggctccctgctcagctcctggggctgctaatgctctgggtctctggatccaggtgggatattgtgatgactcagtctccactcctccctcgccctccacccgtggagacnccgctccatctcagcaggtcacgcagctcctattacagtataagtgtattaccaattgttagtaagttcggtaccnacgagaacgcggaacggctaacgtccaccgacgacgtcccttctagtactttcgttggtttcgtcgtgtaccggtcccgggtccgtacccggggtcctaagtacgtaacggtgtaggcggtagtggtacgtctacgacggactaacgtaagttacgtttaacgacgaaagtaagtacggaaggggtagggtcggtaggtaggtagggaacggttaggtttagggtttacgtttaagtacggttnacgtaagtacgtaacgttagttaacctaaccgttaaccttaccggttacgtttacggttacggtaacccggaagggtaaccctaggcgttaagaaacggtactaaccgtaaaggcgttgacgtacgacanacgtnttcgttacc

SEQ ID NO: 280112 - DNA, 764 bp, Homo sapiens
  misc_feature: GYAE6OF01CNV89.47.38.D05.1.454.CMB.1.raw
tcagagctcacgtacacgaccggtgctcgatttagtatctgatagttgggtttggggaggactcctcagttcaccttctcacaatgaggctccctgctcagcctccgtggggctgctaatgctctgggtctctggatccaggtggggatattgtgatgactcagtctccactctccctcgcccgtccaccccgtggacgacgccggcctccatcctcctagcaggtctagccagacgtcctacttacataagtatggtattacaaacttatttagaaacgttggtaacctgacaagaacgccgagggtacacgtcctaccacgacgtctcctagtacttcggttgtttgggtctcggtacggtcccggggtccgtttcccgggggtcctacgggtaacgtacgggtttccgaagggtcggaccggtaaggtcgggtaactcggaaaggtctaaacgtaacgtttacgtttaacggtaacgttaacgaaaaacggttcgaaaggggttaggggtacgggtaacggtacgttaagggaacgggtttaaggttttaggggttttacggggtttaaacctttaaggtcggtaagtaacggttacgtaaaccgttaacgttaccttaaaacctaaccgttttaacccgtactttaacggggtttaccgaaccggtaacgggtaaactaaccggtgtaaacgggaactaacggttaaaccgaaacggtacgttcggtacggtacgtaaccaccgtacgtacttcgttacg

SEQ ID NO: 280113 - DNA, 372 bp, Homo sapiens
  misc_feature: GYAE6OF01BRJ85.47.38.D05.1.454.CMB.1.raw
  modified_base (363)..(372): a, c, t, g, unknown or other
  misc_feature (363)..(372): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggccacccctcctccaagacgcacctcgtgggggcacgagccggccccgtgggctgcctggtcaaggactacttcctacgtgagctcgtgagcggctggcaaggcgcatacgnnnnnnnnnn

SEQ ID NO: 280114 - DNA, 743 bp, Homo sapiens
  misc_feature: GYAE6OF01EV2V8.47.38.D05.1.454.CMB.1.raw
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggtgcccactcccaggtccaacttgtgcagtctggggctggaggtgaaagaagccgtggggccctcgaggtgtaacggtttcctgccgaccgggccccctgcagacctaccttcagccacctacttaccttcagcgtgggtcgcgacgacggccccgtagggaccgaagggcttggaggtgggagtgggggagggtccgtccgttagttcgtttaggaagaaacgtaaacgtacgacacaacgtaacttccgaagggtcaagtacgtacgaacgtaacgttaccggcggaacgaacgacgtcccgaacgggtcaacgtacgtacctaccgtaggttagggtagttacggacgtaccgaacggtccctagggaacgtagtaccggggttagggggaaccccgtaacgggttaacccgttaacgtttaacgtttaccggttggtaccgggtaccgggtaaagggtaaccccggggtaccggttaaagttttaaagtaacgggttagttaaacgggttcggggttacccggttgggttaccggaccccgttaaccgtttaacgtttacgggtaaaccccggg

SEQ ID NO: 280115 - DNA, 406 bp, Homo sapiens
  misc_feature: GYAE6OF01EFGOZ.47.38.D05.1.454.CMB.1.raw
  modified_base (394)..(406): a, c, t, g, unknown or other
  misc_feature (394)..(406): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggagtgtggggcaaagggaccacggtcaccgtctcctcagcctccaccaagggcccatccggtccttccccctggccacccctcctccaagacgcacctcgtgggggcacgagcggccctgggctgcctggtcaaggactacttcctacgtgagctctggagcgggctggcgaaggcgcatagnnnnnnnnnnnnn

SEQ ID NO: 280116 - DNA, 644 bp, Homo sapiens
  misc_feature: GYAE6OF01AVFJB.47.38.D05.1.454.CMB.1.raw
  modified_base (606)..(606): a, c, t, g, unknown or other
  misc_feature (606)..(606): n is a, c, g, or t
  modified_base (612)..(612): a, c, t, g, unknown or other
  misc_feature (612)..(612): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggttttcagggcagggtcaccatgaccagggacacgtccatcagtacagcctacatggagctgagcagtctgacgacctgacgacacggccgtgtattattgtgtgttagtacggacgtattacgtacgttttgtagttggtctacgttacccggacggtggtcgggacgaaacgggaccgacggtccaccgtctcctcacgccctaccaaccgacggccctacgtccggttccttcccccgtcggaccctacccctcccgtaccgaacgacgacctacccgtcggtaccgggggcaccggacggcccggtcccggtcggggccgtcggtcccgtacggtaccggaacggtaccgttacccgtttacccgttacggtacggtaccggtccgtcggttaggaccgggtacggggtcccgtacggggtccggaaacggggtccggtaaccgtaaggttacgngtacgncgngngngngncgcgngnngcncagcgngngn

SEQ ID NO: 280117 - DNA, 421 bp, Homo sapiens
  misc_feature: GYAE6OF01BWD6A.47.38.D05.1.454.CMB.1.raw
  modified_base (410)..(421): a, c, t, g, unknown or other
  misc_feature (410)..(421): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtggtgggcaaagggaccacggtcaccgtctccctcagcctccaccaagggcccatcggtccttccccctggccaccctcctccaagacgcaccctcgtgggggcacgacgcggcccgtgggctgccgtcggtcaaggtacctacttccctacggtgacgtctcgtgacggcggcgtggacgaacggcgacatagnnnnnnnnnnnn

SEQ ID NO: 280118 - DNA, 451 bp, Homo sapiens
  misc_feature: GYAE6OF01C9Y9W.47.38.D05.1.454.CMB.1.raw
  modified_base (427)..(451): a, c, t, g, unknown or other
  misc_feature (427)..(451): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggcgtgtattattgtgcgttagttacggacgattacgtacgttttgattggtcattacccggacgtgtggggcaaaaggggccacggtcaccgtctcctcacgcctccaccgaacgggcccaagttccggtccttccccctggcccacccctcctaccaagacgcacctcgtgggggacaccgagccgggcccgtgggcctggccgtggtacgaacggacttaccttccgtacgtgaacgtctctggacgcgggcgtggcgaaggccgcgaataggnnnnnnnnnnnnnnnnnnnnnnnnn

SEQ ID NO: 280119 - DNA, 422 bp, Homo sapiens
  misc_feature: GYAE6OF01CHXRD.47.38.D05.1.454.CMB.1.raw
  modified_base (404)..(404): a, c, t, g, unknown or other
  misc_feature (404)..(404): n is a, c, g, or t
  modified_base (410)..(411): a, c, t, g, unknown or other
  misc_feature (410)..(411): n is a, c, g, or t
  modified_base (413)..(422): a, c, t, g, unknown or other
  misc_feature (413)..(422): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggactagggggttactacgttttgattggtcagttacccggacgtgtggggacaaagggccacggtcaccgtctcctcacgcctccaccgaacgggcccatccggtcttcccccctggccaccccttcctcccgaagacgcacctctggggggccacgagccggccctggggctgccctggtacaaggactacttcctagtgagctctgacgtcggctggcaaggcncaatgnngnnnnnnnnnn

SEQ ID NO: 280120 - DNA, 658 bp, Homo sapiens
  misc_feature: GYAE6OF01CG1RV.47.38.D05.1.454.CMB.1.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (642)..(658): a, c, t, g, unknown or other
  misc_feature (642)..(658): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcgagggcagggtcaccatgaccagggacacgtccatcagtacagcctacagtggancgtagagcgagtctgacgtaccgngaccgacgacggccgttagtattagttggtgtacggttagtacggacgtattacgtacgtttgtagttggtactacgttacccggaggtggtcggggacaacgggacccgtacggtaccaccgtcctcctacgcctccgtaccacccggaacgggtaccctacgttcccgttaccccgtttccccccggtcggtacccctacccccgtaccctaccgaacggtaccgacccgtaacccggtccgggtacgggggccctaaccggacccgggcccgggtcccggtcggggtcccgtacggtcccggttacgggtaaccgaacggggttacccttaacccgttccgttacgtaccggacgttccgtccggtggaccggggtccgggtcgtacgggcggaacggcgacgatcgnnnnnnnnnnnnnnnnn

SEQ ID NO: 280121 - DNA, 657 bp, Homo sapiens
  misc_feature: GYAE6OF01C8488.47.38.D05.1.454.CMB.1.raw
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccaggtggggatattgtgatgactcagtctccactcctccctcgccccgtcaccccgtggagacgcccggcctccactcctcctgacaggtctagccagacgccttacttacatagtaatggaattacaactattgaattcggtacctgcaagacgccagggcagtcaccacgcnctcctgntcgttgtttggtctgacgtccgggtccgtccggggtcctagacgtaggtcaggtgcgaggtgactcgaggctaacgagttatttacgactagaaacgtcgtagggttaagggtggacggtagtaggtaagggttaggtttgggtttaggggttttaatacggttgacgtatcggttaaccgtaacggtttcctaaaccgttaaccgttaccgttaaacgtttaccggtttacgggaaccgggtaaccgggtaaccgtaacggtcgtaacgggtaacgtaagtaaaccggtaaaccgtacgtggttacggaccttcggaaccctccgtagttccgttccg

SEQ ID NO: 280122 - DNA, 739 bp, Homo sapiens
  misc_feature: GYAE6OF01BIXPR.47.38.D05.1.454.CMB.1.raw
  modified_base (167)..(167): a, c, t, g, unknown or other
  misc_feature (167)..(167): n is a, c, g, or t
  modified_base (317)..(317): a, c, t, g, unknown or other
  misc_feature (317)..(317): n is a, c, g, or t
tcagagctcacgtacacgaccggtgctcgatttagtatctgatagttggggtttggggtgatcaggactcctcagttcaccttctcacaatgaggctccctgctcagctcctggggctgctaatgctctgggtctctggatccaggtggggatagttgtgatgactnagtctccactctccctgcccgtcaccctggagcgcccggcctccatctcctgcagtctagccagcgtcctacttacatagttaagtggtattcaaacttatttagaatttggtaacctgacaagaacgccgaagggctagtcctaccganacgtcctccgtgtacttcgttggttttgggttctaggacgtccgggtccgtccgggggtaccctcggacgtggttacgtaggttcggacgtaggtcggagtccgaagggacctaacgtacgttaacgttttacggacgttaacgtaaaaacgttcggtaaggggtaggggtaagggacgggtacgtaagggtagggttaagtttcggggttttacgggttttaacgttaacggttcgtacggttaacggtacggtaaccgttaacgttttaccgtaaaccctttaaaccgttacccgttaacgttacccggttttacgggacccggtaacggggtaacccgtaaccggtaccggtacgggtaaccgtaacgttaacccggaaaacgttacggttaggtaggtaccgttagacccgtaacccg

SEQ ID NO: 280123 - DNA, 459 bp, Homo sapiens
  misc_feature: GYAE6OF01E285F.47.38.D05.1.454.CMB.1.raw
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (444)..(459): a, c, t, g, unknown or other
  misc_feature (444)..(459): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagtacggacgattacgacgttttgattggtcagttacccggacgtgtggggacaaagggccacggtcaccgtctcctcacgcctccaccgaacgggcccatccggtccttccccctggccaccctcctccaagacgccacctcgtcgggggccacgacggccggccccgtggggcctcggtacccgttcgggtaccgaaagggtaccttacccgtttaccgtaacggttgacgtcctcgtggacggcgggntcggacgaaggcgcagtagnannnnnnnnnnnnnnnn

SEQ ID NO: 280124 - DNA, 618 bp, Homo sapiens
  misc_feature: GYAE6OF01CGTI3.47.38.D05.1.454.CMB.1.raw
  modified_base (264)..(264): a, c, t, g, unknown or other
  misc_feature (264)..(264): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagccagagtcctcttacatagtaatggacttcaaacttntttagaattcggtacctgacaaggaacgtccgagggcctagtcctaccacgagtccttcctagtacttcgttggtttggtctgaccggttccggtccgtccgggtcctggaccgtaggttccaggtgctaggtcgactcgaagcaacgtagtactttacgactaacgaaatcgtaagggtagggtggtagcgtaggaggtagttcgggttaggtttactacgtgcgtagtacgtacgttagttacctaacgtaaccttcgtaacgttacgtttacggaccggtaacggggtactacggacgtacggtaacgtacgtaaacaaacggtcgttaggtcggtacgtgaccctaaccg

SEQ ID NO: 280125 - DNA, 467 bp, Homo sapiens
  misc_feature: GYAE6OF01ATMSM.47.38.D05.1.454.CMB.1.raw
  modified_base (441)..(467): a, c, t, g, unknown or other
  misc_feature (441)..(467): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgtattacgtagtttttgatttggtcagttacccggagtggtggggacaaagggaccacggtcaccgtctcctcacgcctaccaccgaagggcccctagttccggttccttcccccgtggccctacccctcctaccgaaagacgcctaccgttcggtgggggaccacgacggccggcccgtggggcctcggccgttgggtacgaaacgggtaccttacctttacccgtacggttggacgtccttcgtggacgggccggggtcgtacgggacgtaacgggccgactaagtaggcnnnnnnnnnnnnnnnnnnnnnnnnnnn

SEQ ID NO: 280126 - DNA, 777 bp, Homo sapiens
  misc_feature: GYAE6OF01CPH12.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggatattgtgatgactcagtctccactctccctgccccgtcaccccgtggagacggcccggcctccatcctcctgcaggtctagccagcgccttacttacataagtaatggtattacaactttagtttagaatttggtaccctgacgaaggaagcccgaaggggcaacggtcctccaacacgtcctcctaggtacttcgttggttttcgggttactggacgtcccggggtcccgttcccgggggtccctaggacgtacgggtttcgagggtcggtactagggtacggtacgtcggaacgggacctaaacgtaaggtttaacgtttttaaccggtaaccgttaaaggtaaaaaacgttcggtaaaggggttaggggttagggaacgggtacggtagggtaagggttaaggttttaggggttttaacggggttttactttaacggtggtacctaggttacggtaacgtaacggtttaccttaaaccgtaacctttaccgttaacgtttaacggttttcggaaccgggtaacgggtaccgtaacggtacggtacgggtaaacgtacttaaaccggtaaaacgttaacgttacgggttacggtacgtaccgacgttaaaccgtagttccgtttaccgg

SEQ ID NO: 280127 - DNA, 803 bp, Homo sapiens
  misc_feature: GYAE6OF01DR6WT.47.38.D05.1.454.CMB.1.raw
  modified_base (775)..(775): a, c, t, g, unknown or other
  misc_feature (775)..(775): n is a, c, g, or t
  modified_base (782)..(782): a, c, t, g, unknown or other
  misc_feature (782)..(782): n is a, c, g, or t
  modified_base (784)..(803): a, c, t, g, unknown or other
  misc_feature (784)..(803): n is a, c, g, or t
tcagagctcacgtacacgaccggtgctcgatttagtatctgatagttgggtttgggtgcccaagctgctggagggcacggtcaccacgctgcttgagtggagtgggacggatcagccctaacgagtggtggacaacaaactatgacaacgaggtaggtttcgagggcgacgggtcaccatcgaccgagggaccacgtccatacagtacacgtcctagagtcgggaacgtctaggacgtacgtaagttccgtaggtaccggtaaccgtaggaaccggtaccggaaccgggtccggtttagtttaacgttttagttttcggtcggtttaccggttttaaacgggtttaccgggaacgtttaacggttttaaccggttaacggtttttggtacggttttcgggtacccttaacggttttaacccccgggagggttttacgggtacgggggtaccggaaaaccgggggtacccgtacccgggttaccgtaacccgtcccgttcccttaccggacccgtaccccgtaccccggaaaccggaaccggtccccgtaacggttccccggttcccctttacccccgggcgtacccctaccccgtccgtaaccgaacggtacgcccggttacccgtggggtccgggacctacggccgggaccccggtcggtaccgggtccgtcgggttacccgtaccggtacggtaaccggttaacccttaccgttcccggtaacgtcggctaccgttcgtggtaccgggcggtcggtacgacggtacgacggtntaagcgngnnnnnnnnnnnnnnnnnnnn

SEQ ID NO: 280128 - DNA, 635 bp, Homo sapiens
  misc_feature: GYAE6OF01CTWSO.47.38.D05.1.454.CMB.1.raw
  modified_base (122)..(122): a, c, t, g, unknown or other
  misc_feature (122)..(122): n is a, c, g, or t
  modified_base (613)..(619): a, c, t, g, unknown or other
  misc_feature (613)..(619): n is a, c, g, or t
  modified_base (621)..(632): a, c, t, g, unknown or other
  misc_feature (621)..(632): n is a, c, g, or t
  modified_base (634)..(635): a, c, t, g, unknown or other
  misc_feature (634)..(635): n is a, c, g, or t
tcagagctcacgtacacgaccggtgctcgatttagtatctgatagttgggtttgggtgcccaagctcgctggagggcacggtcaccacgctgcttgagtggatggggacgatcagccctaanagtggtggcaactaaactatgcacagtaggtttcagggcagggtcaccatgaccagggacacgtccatcagtacagcctacgatggacgctaggacgcgagtctgacgacctgacgacacggtcgttgtattattgtgtcgttaagttacggacgtattacgtacgttttgattggtctacgttacccggtacgtggtgggacgaaacggaccgacggtcctacgtctcctcacgtcctacctacgaaacgggcccacgttccggttccctttcccccgacggtaccctaccccttccctacccgtaaacgaccgtaccgaacccgttcggtacggggggaccacgtaacggtcccgggaccccgttacggggccgttacgggacccgttcgggtaccctaaaacgggtaccctttaaccgttaccgttacgttacgacgtccttcgacggacggacggggtccgacggacgaacgggctacgagtacggnnnnnnngnnnnnnnnnnnngnn

SEQ ID NO: 280129 - DNA, 757 bp, Homo sapiens
  misc_feature: GYAE6OF01EJZL1.47.38.D05.1.454.CMB.1.raw
tcagagctcacgtacacgaccggtgctcgatttagtatctgatagttgggtttggggaggactcctcagttcaccttctcacaatgaggcctccctgctcagctcctggggctgctaatgctctgggtctctggatccagtggggatattgtgatgactcagtctccactctccctgcccgtcaccctggagacgccggcctccatcctcctgctaggtctacgccagacgtcctacttaacgattaagtaagtcggtaattactaaacgttatttagtaaactttcgggtaccctagactaaaggaacgccccgaaggggtcctaggttcctacccgacgtacgtcccgttcccgtagtacgtttcggtttaggtttcgggtttctcggtaaccggtccggggtcccgttcccgggggttccctggtaaccggtagggttcagggtcggacgtaggtaggtactacggacggactacgtaacggttacttttacggacttaagaaacgtcggtaagggtagggttggaaccggtgtaggaagggttgtttaggggttttagggtttaacttcgtggtacgtagttacggtaacgttaaaccggtttaccttaaaccgttaaccctttacccgttaacttaccggtttacgggaacccgtaaggggtaaccctaggtacccggttaaggtaaccgtaactaaccggtaaacggtaacggttggtaccggtactacggaccttacgtcgtcgttaccg

SEQ ID NO: 280130 - DNA, 598 bp, Homo sapiens
  misc_feature: GYAE6OF01C4UMX.47.38.D05.1.454.CMB.1.raw
  modified_base (316)..(316): a, c, t, g, unknown or other
  misc_feature (316)..(316): n is a, c, g, or t
  modified_base (561)..(562): a, c, t, g, unknown or other
  misc_feature (561)..(562): n is a, c, g, or t
  modified_base (564)..(598): a, c, t, g, unknown or other
  misc_feature (564)..(598): n is a, c, g, or t
tcagagctcacgtacacgaccggtgctcgatttagtatctgatagttggggtttgggtgcccaagctgctggagggcagggtcaccatgaccagggacacgtccatcagtacagcctacatgggagctggagcagtctgacgacctgaccgacacgggccgtgtattattgtgcgttagtacggactattacggtacgttttgatttggcagttacccgggagtggtaggggacaaaaggggccacggtcaccgtctccctcacgccctaccaaccgaaacggggccccaacgttcccggttcctttcccccccgngggacccctaacccccttacccgtacccgaaaaggaccggacctaacccgtccggttacgggggggaccaaccgaacgggtccccggggcccccgttggggggccctttcgggaccccggttaggggttaaccaaaacggggttacctttaacccgtttaccccgttaaaccggtggtaacgtccgtttacggacggggtaacggccggggtacgtacgggacgaaacgggccgactaaggaagnngnnnnnnnnnnnnnnnnnnnnnnnnnnnnnnnnnnn

SEQ ID NO: 280131 - DNA, 675 bp, Homo sapiens
  misc_feature: GYAE6OF01EKY57.47.38.D05.1.454.CMB.1.raw
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
  modified_base (456)..(456): a, c, t, g, unknown or other
  misc_feature (456)..(456): n is a, c, g, or t
  modified_base (653)..(653): a, c, t, g, unknown or other
  misc_feature (653)..(653): n is a, c, g, or t
  modified_base (661)..(661): a, c, t, g, unknown or other
  misc_feature (661)..(661): n is a, c, g, or t
  modified_base (665)..(665): a, c, t, g, unknown or other
  misc_feature (665)..(665): n is a, c, g, or t
  modified_base (669)..(669): a, c, t, g, unknown or other
  misc_feature (669)..(669): n is a, c, g, or t
tcagagctcacgtacacgaccggtgctcgatttagtatctgatagttgggtttggggagggacgtcctcagttcaccttctcacaatgaggctccctgctcagctcctggggctgctaatgctctgggtctctggatccaggtggggatattgtgatgactcagtctccactctccctgcccgtcaccccgtggacgagcccggccctctactcctcgtgacgnggtactacgacgacgacgtccttactactaagttacgtaaagtgtaacttactaaagttagtttagtaacgttcggttaccncggaacaacggtaaccggacggacgggtactacgtcccgtaacgaacgacgttcctaccgtaggtacttcgtttgggtttcggtctagtcggtcccggtccgtcccgggtactgtaacgtcggttacgacggtgaccgtaggtacgtacncggaacgactaacgtacgtttaacttacgacttaaagaacgtcgaagggtagggtgaacgtctagggacggttgttaggggttttacggttaactacgtggactagggtcgtaaaccttacgttaccgtaaacttaaccttacgtacgtttacgtggaaccggtaggacttagacgtgtaacgattacgaaattcgngtcgtacncganactnggttac

SEQ ID NO: 280132 - DNA, 464 bp, Homo sapiens
  misc_feature: GYAE6OF01B5VF2.47.38.D05.1.454.CMB.1.raw
  modified_base (403)..(403): a, c, t, g, unknown or other
  misc_feature (403)..(403): n is a, c, g, or t
  modified_base (438)..(438): a, c, t, g, unknown or other
  misc_feature (438)..(438): n is a, c, g, or t
  modified_base (440)..(464): a, c, t, g, unknown or other
  misc_feature (440)..(464): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccgggacgtggtgggcaaagggccacggtcaccgtctcctcagcctccaccaagggcccatcggtccttcccccgtcggccacccctccctccaaagacgccaccgtccgtcggggggcaccgacgccggccccgtggggcctcggtcccgtgggtaccgaaagggtacctacttcccgtacggtcgacgcctcnggtacgggcgggctgggacgaaggtccgcataggnannnnnnnnnnnnnnnnnnnnnnnnn

SEQ ID NO: 280133 - DNA, 589 bp, Homo sapiens
  misc_feature: GYAE6OF01EGX6B.47.38.D05.1.454.CMB.1.raw
  modified_base (535)..(536): a, c, t, g, unknown or other
  misc_feature (535)..(536): n is a, c, g, or t
  modified_base (539)..(589): a, c, t, g, unknown or other
  misc_feature (539)..(589): n is a, c, g, or t
tcagagctcacgtacacgaccggtgctcgatttagtatctgataggttgggtttgggtgcccaagctgctgggagggcacggtcaccacgctgctgagcagtctgagacctgacgacacggccgtgtattattgtgcgttagtacggacgtattacgtacgttttgagttcggtactacgttacccgggaggtgggtacgggggacaaaacgggggccctaacgggtcctaacccggttcctccctacgaccgtccctaccaaacccggaacggggcccctaggttccccgggttcccctttcccccccgtaggaccccctacccccgttcctaccgaaaggccgtcccgtaacccggttcgggtcggggggaccaaccggtcgggccccgggtccccggttgggggccttccgggacccgttacggggtaaccgaaaaccgggtacccctttaaccctttcccggtaacggtcgaccgtccgtacgtcgggacgggccggggtcgttcgggaacgaacggggcaactaggtagnntannnnnnnnnnnnnnnnnnnnnnnnnnnnnnnnnnnnnnnnnnnnnnnnnnn

SEQ ID NO: 280134 - DNA, 382 bp, Homo sapiens
  misc_feature: GYAE6OF01CGW30.47.38.D05.1.454.CMB.1.raw
  modified_base (374)..(382): a, c, t, g, unknown or other
  misc_feature (374)..(382): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgtacgttttgattggtcattacccggacgtgtggggcaaagggaccacggtcaccgtctcctcagcctccaccaagggcccatcggtccttccccctaggccacccctcctaccaagagcacctcgtgggggcacagccggccctggggcctgcctggtcaacggctaccttcctacgtgagctcgtgagcgggctgggacaaggcgcatagnnnnnnnnn

SEQ ID NO: 280135 - DNA, 391 bp, Homo sapiens
  misc_feature: GYAE6OF01D4L6W.47.38.D05.1.454.CMB.1.raw
  modified_base (288)..(288): a, c, t, g, unknown or other
  misc_feature (288)..(288): n is a, c, g, or t
  modified_base (379)..(391): a, c, t, g, unknown or other
  misc_feature (379)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattatgtgcgttagttacggacgattacgacgttttgattggtcattacccggacgtgtggggcaaagggaccacggtcaccgtctcctcagcctccaccaaggccatcgtctccctgcaccctctcagncactcgtggggcacgcgcggcctggctgcctggtcaaggtactacttcctacgtgacgtctctgagcgggctcggacaaggcgacagtagnnnnnnnnnnnnn

SEQ ID NO: 280136 - DNA, 395 bp, Homo sapiens
  misc_feature: GYAE6OF01ATDRQ.47.38.D05.1.454.CMB.1.raw
  modified_base (385)..(395): a, c, t, g, unknown or other
  misc_feature (385)..(395): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggccaccctcctccaagagcacctctgggggcacagcggccctgggctgcctggtcaaggactacttcctacgtgagctctgagcggctggcaaggcgcatagnnnnnnnnnnn

SEQ ID NO: 280137 - DNA, 433 bp, Homo sapiens
  misc_feature: GYAE6OF01EXHQL.47.38.D05.1.454.CMB.1.raw
  modified_base (412)..(433): a, c, t, g, unknown or other
  misc_feature (412)..(433): n is a, c, g, or t
tcagagctcacgtacacgaccggtgctcgatttagtatctgatagttgggtttgggtgcccaagctgctggagggcaggatcaccatgaccagggacacgtccatcagtacagcctacatggagctgagcagtctgagacctgacgacacggccgtgtattattgtgcgttagttacggacgattacgacgttttgattggtcattacccggagtgtggggcaaagggaccacggtcaccgtctcctcagcctccaccaaggcccatcggtcctcccctgccaccctcctccaagacgcacctcgtgggggccacgacggccggcccgtcgggctcgcctggtacaagggtacctaccgttcctacgtgagtctcgtgacgcgggtcgtcgggacaacggccgacaagtagnnnnnnnnnnnnnnnnnnnnnn

SEQ ID NO: 280138 - DNA, 732 bp, Homo sapiens
  misc_feature: GYAE6OF01A9658.47.38.D05.1.454.CMB.1.raw
  modified_base (221)..(221): a, c, t, g, unknown or other
  misc_feature (221)..(221): n is a, c, g, or t
  modified_base (708)..(708): a, c, t, g, unknown or other
  misc_feature (708)..(708): n is a, c, g, or t
  modified_base (712)..(716): a, c, t, g, unknown or other
  misc_feature (712)..(716): n is a, c, g, or t
  modified_base (718)..(724): a, c, t, g, unknown or other
  misc_feature (718)..(724): n is a, c, g, or t
  modified_base (726)..(729): a, c, t, g, unknown or other
  misc_feature (726)..(729): n is a, c, g, or t
  modified_base (731)..(732): a, c, t, g, unknown or other
  misc_feature (731)..(732): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggaccacgtccatcagtacagcctacatggagctgagcaggtctganacctgacgacacggcgtgtattagttgtgacgttagttacggagagtttacgacgtttttgactttggtactaagttaccccgggaagttggttacgggggacgaaaaacgggtacccgaacgggttacctaacccggttccttacccgttaccgacgtaccccgttaccccgaaccgaaaacggggtcccccaaacgtttcccccgggttaaccttttcccccccgtgggtacccctaaccccccgttcccttaccccgaaaacgtacgacccccgtaacccgtttcccgggacggggggtacccaaccggttaacgggcccggttcccggtcgggggtacccttccggaccccggtttacggggttaccgaaaaccgggttaccttaacccggtttacccgtttaacggttcgggtaaacgttccgtcggttacggaccgggttcggggacctagggaccgaaacggggccgtacgagttacggngcgnnnnncnnnnnnncnnnngnn

SEQ ID NO: 280139 - DNA, 740 bp, Homo sapiens
  misc_feature: GYAE6OF01CL8MP.47.38.D05.1.454.CMB.1.raw
  modified_base (249)..(249): a, c, t, g, unknown or other
  misc_feature (249)..(249): n is a, c, g, or t
tcagagctcacgtacacgaccggtgctcgatttagtatctgatagttgggtttggggtgatcaggactcctcagttcaccttctcacaatgaggctccctgctcagctccgtggggctgctaatgctcgtgggtctctggactccgaggtggggatattgtgatgactcagtcctccactcctcccgtcgaccccgtccaccccgtggacgacgcccgtcctccatcctccgtgcgaggtcacgcagcnccttatacagtagtaatgacttactaattatttagaacgtttcggacctgacaaggaacgccggaggactcgtacctaccacgtacgtcctaccttagtacgttcgtttggtttacggtcctaggtccggtcccgggtcccgttacccggggtccctaggtaccgtgggttcgaggttgggacgtagggtcgtacgtaccggaggtacctaacgttaacgtttacgtttaaccggaacgttaaacggtaaaacgttacgggtaaggggttaggggtaggtacgggtacggtagggtaggtttaggttttagggtttaagggtttacttacggtgaacgtagttacgtaaccgttacgttaaccttaaccttaaccgtttaccgtaacgtttaccggtttacgggaacccggtaagggtaaccgtaaggtcggtacggtaaacgtacctaaaccggtaacggtacgttggacgtaccgagtaaccctaccgg

SEQ ID NO: 280140 - DNA, 569 bp, Homo sapiens
  misc_feature: GYAE6OF01CJ0KG.47.38.D05.1.454.CMB.1.raw
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagacgcccggcctccatcctcctgcaggtctagccagacgcctcttacatagtaatgattcaacttattgattggtactgacaaaagcagggcagtctccacactcctgatctagtttgtcttttaagcgggcctccgggtcctgacctaggtcactggcagtgatcgagcacagtatttacattanaaactnagacaagagtggagtctaggacgtatgcgtaggtaattttatacgtgacattgactaacgtaacctaaaactaaccttcctttacgaccgttaccggaccgtaaaggaccgaaccgtagtacggactaaaggttacggaaccgtaacgttcggtaggtactacggtaccaacccgttagttacccg

SEQ ID NO: 280141 - DNA, 450 bp, Homo sapiens
  misc_feature: GYAE6OF01C7UHE.47.38.D05.1.454.CMB.1.raw
  modified_base (445)..(450): a, c, t, g, unknown or other
  misc_feature (445)..(450): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgtcgttagttacggacgatttacgtacgtttttgattggtcagttacccggacgtggtggggacaaagggccacggtccaccgtctcctcacgccctccaaccgaacgggcccatccggttccctttccccccgtcggcctacccctccctaccaaacgacgccacccgtcgtcgggggccacacggccggcccgtcgggccgcgtccgtggtacaacgggtactacgttcctatcgtatactctaggacggcgggtcgtcggcaacggcgacagtagnnnnnn

SEQ ID NO: 280142 - DNA, 771 bp, Homo sapiens
  misc_feature: GYAE6OF01CH9YZ.47.38.D05.1.454.CMB.1.raw
  modified_base (763)..(763): a, c, t, g, unknown or other
  misc_feature (763)..(763): n is a, c, g, or t
tcagagctcacgtacacgaccggtgctcgatttagtatctgatagttggggtttgggggtgatcaggactcctcagttcaccttctcacaatgaggcctccctgctcagctccgtggggctgctaatgctcgtgggtctcgtggactccgaggtgggggtattagttggtagatcgtacctcgtacgtcctccctaccttccctccccgtcggtccccgtacccaccccgtgggaacgccggcccggtcccctaccacttccctccggtggaccgtacggttccacggaccgaacggtacctcccttacttaacaagttaggtaaagtgtaacttactaaattagtttacgtaaagttcggtacctgacgaaggaccggacgtagggacagtccctaccacgacgtcctaccgtagtctttcggtttggtttcgggtactggcggttcccggggtccccggttaccgggttccgaggtaaccggtggttacggaggtcgggtactggtacgtaacgtcggaacgtctaacgtagttaacgttaacgtaccgtaaagtaaacgttagggtacggtaagggggtcggtagggtacggtagggtagggttggttttagggtttacgggtttaataccgttaggcttaacggtataaccggttaattaccttaaacgtaaccttccgttaaacgttcggttacggaccggaacggtaccgacggtaggttacggaagaacggtaacttaaagtcggtagtcggtacngacctacg

SEQ ID NO: 280143 - DNA, 763 bp, Homo sapiens
  misc_feature: GYAE6OF01E0UCH.47.38.D05.1.454.CMB.1.raw
  modified_base (408)..(408): a, c, t, g, unknown or other
  misc_feature (408)..(408): n is a, c, g, or t
tcagagctcacgtacacgaccggtgctcgatttagtatctgatagttgggtttggggtgatcaggactcctcagttcaccttctcacaatgaggctccctgctcagctccgtgggctgctaatgctctgggtctctggatccaggtgggatattgtgatgactcagtcctccacctcctccctcgccctatccaccccgtggagacgcccggcctccatcctcctgcgaggtctacgccagactcctacttaacataagtaagtgtaattactaattatttagaagtttcggtacctgcaggacgccgagggctagtcctccacacgtcctctgtacttcgttgggtttggttctggtacgtccggggtcccgtcccggggtccctgacgttacggttcgaggtcggngtacggtggacgtacgaggtacctaacgtaacgttaacgtttaacgtacgtaaagtaaaacgtacggtaagggttaagggggtacggggtaacggtacggttaggggtaagggtttaggttttaggggtttttaacggggttttaacgtttacggttacggtaccgttagttaccgggttaacgttaaaccggttttaaccttaaaccgttaaacccgtttaaccgtttacccggtttaccggttttaccggggacccggtaaaccgggggtaacctaacgggtacggtaggtaaaccggtaaactaaacccggtaaacgttaccggttagggttaccggtccgttcggtaaccc

SEQ ID NO: 280144 - DNA, 507 bp, Homo sapiens
  misc_feature: GYAE6OF01E1LFA.47.38.D05.1.454.CMB.1.raw
  modified_base (464)..(507): a, c, t, g, unknown or other
  misc_feature (464)..(507): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgtttagttacggacgattacgacgttttgattggtctagttacccggacgtggtggggcaaagggccacggtcaccgtctcctcacgcctccaaccgaacgggcccatccggtcccttcccccgtcggccacccttcctaccaaacgagccaccgtcggtcgggggccaccgacggccggtcccgtggggcctcggcccgttgggtaccgaaagggtaccttaccgtttccgtaacgtggacgcttcgtagggacggtcggggcgtcgggactaaggggccgtacgtagtaacggnnnnnnnnnnnnnnnnnnnnnnnnnnnnnnnnnnnnnnnnnnnn

SEQ ID NO: 280145 - DNA, 684 bp, Homo sapiens
  misc_feature: GYAE6OF01AZ5IR.47.38.D05.1.454.CMB.1.raw
  modified_base (658)..(658): a, c, t, g, unknown or other
  misc_feature (658)..(658): n is a, c, g, or t
  modified_base (662)..(662): a, c, t, g, unknown or other
  misc_feature (662)..(662): n is a, c, g, or t
  modified_base (665)..(667): a, c, t, g, unknown or other
  misc_feature (665)..(667): n is a, c, g, or t
  modified_base (669)..(671): a, c, t, g, unknown or other
  misc_feature (669)..(671): n is a, c, g, or t
  modified_base (675)..(675): a, c, t, g, unknown or other
  misc_feature (675)..(675): n is a, c, g, or t
  modified_base (677)..(678): a, c, t, g, unknown or other
  misc_feature (677)..(678): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcaacaaactatgcacagaggtttcagggcagggtcaccatgaccagggacacgtccatcagtacagcctacatggagcgtgagcagtctagacgaccgtgaccgacaccggcgtgttattattgtgtcgttagtacggacgtattacgtacgtttgagtttcgtctacgttacccggtggtacggtcggggacgtaaacgggacccgacggtaccaccgtctccgtacacgccctacccaaccggtaaccgggccctaacgttccggtcccctttacccccgtccggtaccctacccccgtttacccaccgtaacgaccgccctaccgttccggtcgggggaccaaccggccggcccgggtcccccgttaggggcccgttcggtacccggtttcgggtaacctaaccgggttaaccctttaacccgtttaccgttaacgggtacgtaccgtccggttaacgttcgggaccgggtccggggtcgttacggggaacccgaacggggccgtaaccgtaggtaaggccagcgntgcngcnnncnnngtcncnncngngn

SEQ ID NO: 280146 - DNA, 884 bp, Homo sapiens
  misc_feature: GYAE6OF01A83R5.47.38.D05.1.454.CMB.1.raw
  modified_base (447)..(447): a, c, t, g, unknown or other
  misc_feature (447)..(447): n is a, c, g, or t
  modified_base (531)..(531): a, c, t, g, unknown or other
  misc_feature (531)..(531): n is a, c, g, or t
  modified_base (693)..(693): a, c, t, g, unknown or other
  misc_feature (693)..(693): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtcctgtgctagtggggtggtaattgttgagtagtacgtcctagtacttccctacctaccttccccgttcccgccccggtcccgtaccccctaccggtagggaacgcccgggccccgtccctaactccttcccgttcgtaccgacgggttaccgtacgtccgaacgtaacggtacccttcctttaacctaagttaaagttaaagttaggtacttaccttaaaccgttaatttttacgttaagttagttacccggtacgtcggaaagaaacggtaccggagggtaccggtatccgttaccccaaccgtagccgtccttacgtnttacgttttcgggttttgggtttcgtcgtacggtccgggtcccgttccccggggttaccggtctaagggtcgttacgggttcgnggtccggtagtaggtaccgtacgaagggtcccgaagttaaaccgtttagtttttaaccggtacgtaacgtaaaacgtacgtagggttaagggggttcgggtaggtcggtaaggtacggggttgttttaacggggttttgggtttttaaggttaacttcgggngttaacgttacttaaccggtaacgtttaactttaaaccctaaacgtttacccgttaacgtttaccgttttacgggaccgtaaccggggaacgttaacggcgttaacgggtcgtaaacctacccggtaaaaagtaccgggttgttaccgggactacggtaccccgaaattcccgttagtttcccggttaccc

SEQ ID NO: 280147 - DNA, 625 bp, Homo sapiens
  misc_feature: GYAE6OF01BS78J.47.38.D05.1.454.CMB.1.raw
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgcccggcctccatcctcctgcaggtctacgccagacgccttctaacatagtaatggtacttacaacttatttgaattcggtacctgctaagaacgccgagggtcacgtcctccaanacgcctctagnttcgttggttcggtctgacgtccggccgtaccggggtcctgacgtggttcaggtgcgtaggtgatacgagactacgtagttatttaacattagaaactcgaagacaggtggtaggagacgtgaccgagtcggtagttaggtactttaatgtacgtctagtacgacgtaacgtaacctaaaaccgttacctttaccgttaccgtaacccggtacccggtaaccgtaaacggggtacccaaccggtaccggttaacgtaaccttaaggttaaccggaacccgttaaacgggtgtacccgg

SEQ ID NO: 280148 - DNA, 394 bp, Homo sapiens
  misc_feature: GYAE6OF01A3NMB.47.38.D05.1.454.CMB.1.raw
  modified_base (280)..(280): a, c, t, g, unknown or other
  misc_feature (280)..(280): n is a, c, g, or t
  modified_base (379)..(394): a, c, t, g, unknown or other
  misc_feature (379)..(394): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaaggggcccagtccggtccttccccctggccacccttcctccaagcnccacctcgtcggggcacgagccggcccgtggctcgccgtggtacaaggactacttacctatcgtatactctgagcgggcgtcggacacggcgcataggnnnnnnnnnnnnnnnn

SEQ ID NO: 280149 - DNA, 826 bp, Homo sapiens
  misc_feature: GYAE6OF01AYBDE.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggatattgtgatgactcagtctccactcctccctgcccgtcaccctggagacgcccggcctccatctcctgcaggtctagccagacgcctcctgcagactaatggaaatctagttgattgtacctgacaaagccgaggcacgtctccactaacctcctagtactaccgtttagttttcggtacgttttaaacgtcccggggtacccgttccccgggggttaccccttggaaccgtacggtttacccgaacggttcgggtaccgtaaggggtacgggtaaccgttaccgaacggggtacccgtaaaccggtaaggtttaaaccgttttttaaaacccaaagttttaaacgtaaaaacgtttaaccgaacgggttaacgaaacgggttaaaggggttacgggggaaaacgggtcgttaaacggtaaccggtaacggttacggtaccgggtttaaagggtttacggtttttaacgtttaaccttcggggtaacctaacgttacggaaccttaaaacggtaaacccgtttaaaacccttaaaacccgttttcccgtttaaccgtaacccgtttccggtaaacccgaaacgggtaccgtaaccggtaccggtacggtaaacctaaggttaaaccgtaaccgaaacgttcggtaccgggtacttaccggaccctaaggttacttaccgg

SEQ ID NO: 280150 - DNA, 608 bp, Homo sapiens
  misc_feature: GYAE6OF01EDRG0.47.38.D05.1.454.CMB.1.raw
  modified_base (588)..(593): a, c, t, g, unknown or other
  misc_feature (588)..(593): n is a, c, g, or t
  modified_base (596)..(608): a, c, t, g, unknown or other
  misc_feature (596)..(608): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcaggtctagacgacctgacgacgaccggccgtgtattagttgtgtacgttaagttaccggacgtattacgtacgttttgagtttggtctacgttacccggtacggtggttggggacgaaacggggaccgtacggtccaccggtctcctcaacggccctaccgaaccgaacgggcccacgtccggttcccttccccccgtcggcccaaccccgttccctacccgaacggtaccgccgtacccgtcgggtcgggggaccacgacggccggtccccgtggggcctcggcccgttaggtaccgaaaggtacccttaccgttacctacggtgacgtccgtcgtcggacggcgggcgtcggaccggaacggcgacgaagtgcgnnnnnngcnnnnnnnnnnnnn

SEQ ID NO: 280151 - DNA, 415 bp, Homo sapiens
  misc_feature: GYAE6OF01CFEK8.47.38.D05.1.454.CMB.1.raw
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (407)..(415): a, c, t, g, unknown or other
  misc_feature (407)..(415): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcaggtctgagacctgacgacacggccgtgtattattgtgcgtttagttacggacgtattaccgtagttttgattggtctattacccgggacgtgtggggcaaagggaccacggtcaccgtctcctcagccctccaccaagggcccatccggtccttccccctggccacccctcctccaagacgcacctcgtgggggcacagtccggcctgggctcgcctggtcaaggacttacttcctacggtnacgctcgtgagcggctaggnaaggtcgcaancgnnnnnnnnn

SEQ ID NO: 280152 - DNA, 675 bp, Homo sapiens
  misc_feature: GYAE6OF01BTIK7.47.38.D05.1.454.CMB.1.raw
  modified_base (235)..(235): a, c, t, g, unknown or other
  misc_feature (235)..(235): n is a, c, g, or t
tcagagctcacgtacacgaccggtgctcgatttagtatctgatagttgggtttgggggaggactcctcagttcaccttctcacaatgaggctccctgctcagctccgtggggctgctaatgctctgggtctctggatccgaggtggggatagttgtgatgactcagtctccactctccctgccctccaccctggacgacgccggcctccatcctcctggcaggtctagccaggancctacttacataagtaatggattcaattattagaacttggtacctgactaagaacgccgagggccagtcctccacgacgtctcctagatcggttgtttcgggtctggtacgtccggggtccttccgggggtaccctggacctagggttccaggtggcgtaggtcgatgacggtacacgagttaatttacgcgttaagaaatcgaaggttagggaggtaaggtcgtaggaggtaaggtttgggtttaggggtttaactttacggcgtactacgtaggtaacctaacgttacgtaaactaacccgtttactaacgtttaccggttacggtaaccgtaacggggtaacaacggtaccgtagggaacgttaccgttaaaccgaaaaccggttaacgtagggtttaccggaccgttacggacccgtacttaaccgttgtaacccg

SEQ ID NO: 280153 - DNA, 979 bp, Homo sapiens
  misc_feature: GYAE6OF01A347D.47.38.D05.1.454.CMB.1.raw
  modified_base (168)..(168): a, c, t, g, unknown or other
  misc_feature (168)..(168): n is a, c, g, or t
tcagagctcacgtacacgaccggtgctcgatttagtatctgatagttgggtttggggtggtagtcaggactcctcagttcaccttctcacaatgaggctccctgctcagctcctggggctgctaatgctcgtggtctctggatcgaggtgggatagttgtgatgactnacgtctccactcctccctacgcccgtccaccccgtggacgacggcccggtcctccacttccgtccgtgtccgtaaggtcacgtccgaagcgtcccttacgttaactacgttaaggttaaagttcgggtaactttaaccctaaacgttttaagttttaaacggtaacgttttacggggttaacccccttagggtaccgaaaacggtaaacggtaccccgggtaacgggggtacccttaaacggttccgttaccccgaaacggttaacgtccccgtttaacgttcggttaaccgttcggtttttacggggtttttcggtttacgaacggttaccgggttcccggggtccccgtttaaccccggggggtacccgttacggtaaacgggtttcgggttaccgtaaacgggggttcggggtaaacccggtaggggtttacggtaaaccgggttaacccgacgggggttaaccttaaacgttaaccgggttttaacggtttaaacccggtacggttaaaagttaaaaacccggttaagggtaacgggggtttacggggaaggggttaaccggttcgtaagggggtagttttaacggggttgggtttttaaacggggttttaactaacgggtacgtaacgtttaacggtacgttaaacgttaacgtttaaaccgttaacccggttaaaaccctttccggttaaacgttaccgggtttaacgggtaacccgggaacggtaaaccgtcgtaaccgggtgggttaaaacaccggttaaacgaaacggttacggtaggtcggaacctaacgcgttaaaccgg

SEQ ID NO: 280154 - DNA, 776 bp, Homo sapiens
  misc_feature: GYAE6OF01CUNKF.47.38.D05.1.454.CMB.1.raw
  modified_base (209)..(209): a, c, t, g, unknown or other
  misc_feature (209)..(209): n is a, c, g, or t
tcagagctcacgtacacgaccggtgctcgatttagtatctgatagttggggtttgggggagcatcacccagcaaccacatctgtcctctagagaatcccctgagagctccgttcctcaccatggactggaccgtggaggactccttcttcgttggtggcagcagccacaggacgtccactcccgagttgacaacgtggtgcgtagtcgnggggctaggaggtagaagacgccgtagggcctcgaaggtggaacggttctccgtagacgaaggtcttcgtaggaactacgagtaccttaccaaccgtacttaacttagtttacgcgtacggtggggtacggaccggtacccgggcccgtaggaaccggtaacgggtcgttaggacggttagggacggtacggggaacggtacgtaccgaaccggtacccgtaaggtagggtcggtacgaccgtaaacgtaaaactagtacggaacgaagtagggttaacggttacggaaacgggcggtaaccgggtacccgaacgtaacggtaccggaaaccgggtacgggtaccccgtaaaccgttcccggaaacttaccggtaacgtaaccgtacgtacccgtaagtacggtaacgggacgtaccgtaggaccgactaagggttaccaggtaaccgaccgttacggaccgacggtacggtaccgttagttagttagtcggtacggttacggttacgttaacgggtacttaaggttaccggtttagttaggttacggttaggtccgttaaaccggg

SEQ ID NO: 280155 - DNA, 497 bp, Homo sapiens
  misc_feature: GYAE6OF01BPVCL.47.38.D05.1.454.CMB.1.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (441)..(497): a, c, t, g, unknown or other
  misc_feature (441)..(497): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgtttagttacggacgattacgacgttttgattggtcattacccggagtgtggggcaaaagggccaggtcaccgtctcctcagccctaccaccgaagggcccctaagttccggtcctttccccccgtggccctacccctcctaccaagacgccaaccgttcgtgggggccacgacggccggcccgttggggcctggcccgtgggtacgaaacgggtaccttaaccgtttcctaaccggttggacggtcctccggttggacggcgggggtactgggacctaaagggcccganaaactggcngancgannnnnnnnnnnnnnnnnnnnnnnnnnnnnnnnnnnnnnnnnnnnnnnnnnnnnnnnn

SEQ ID NO: 280156 - DNA, 498 bp, Homo sapiens
  misc_feature: GYAE6OF01CHJWA.47.38.D05.1.454.CMB.1.raw
  modified_base (452)..(452): a, c, t, g, unknown or other
  misc_feature (452)..(452): n is a, c, g, or t
  modified_base (455)..(498): a, c, t, g, unknown or other
  misc_feature (455)..(498): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgtttagttacggacgatttacgtacgttttgattggtcacgttacccgggacgtggtggggacaaaaggggccacgggtcaccgtctcctcacgccctccaccgaacgggcccatcggtccttccccctggccacccctcctccaagacgccacctcgtgggggccacgtaggccggccccgtggggcctcggcccgtggtaccgaacgggtaccttaccgtttcctaacggtgacgcttcgtggacggccggggtctcgggaccgtaagggccgacaagtagncgnnnnnnnnnnnnnnnnnnnnnnnnnnnnnnnnnnnnnnnnnnnn

SEQ ID NO: 280157 - DNA, 593 bp, Homo sapiens
  misc_feature: GYAE6OF01BDSEH.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgccccgtcaccccctggagagccggcctccatctcctgcaggtctagccagagcctcttacatagtaatggattcaactatttgaattggtacctgcagaagccagggcagtctccacagctcctgattcgttgtttgggttctgacgtccgggcccgtccggggtccctgacgtaggttcaggtcggctaggtcggatacgaggcacgtagtactttacgctagaaatcgaggtagggtaggaggtcgtagagggtagttggtttagggttttattacgtgcgtagtgtacgtaacgttacgtaacctaacttacccttaacttacgttttcggaccgtacggggtaccaacgtcgtaggtacgtagtaacgtaaacgtacgtaggtacggtctacggaccaacctgttccgttacg

SEQ ID NO: 280158 - DNA, 423 bp, Homo sapiens
  misc_feature: GYAE6OF01EUMET.47.38.D05.1.454.CMB.1.raw
  modified_base (94)..(94): a, c, t, g, unknown or other
  misc_feature (94)..(94): n is a, c, g, or t
  modified_base (391)..(423): a, c, t, g, unknown or other
  misc_feature (391)..(423): n is a, c, g, or t
tcagagctcacgtacacgaccggtgctcgatttagtatctgatagttgggtttgggtgcccaagctgctggagggcacggtcaccacgctgctnagcagtctgagacctgacgacacggcgtgtattattgtgcgttagttacggacgattacgacgttttgattggtcagttacccggagtggtggggcaaagggaccacggtcaccgtctcctcagcctccaccaaggcccatccggtccttcccccctggccacccctcctaccaagacgccaccgtcgtggggggcacgacgcggcccctgggcctgcctggtcaacggactaccttccgtacgtgacgtgtactgggacggtccggggctgggaccgaacgggcctacgacgtagnnnnnnnnnnnnnnnnnnnnnnnnnnnnnnnnn

SEQ ID NO: 280159 - DNA, 755 bp, Homo sapiens
  misc_feature: GYAE6OF01CFGL7.47.38.D05.1.454.CMB.1.raw
  modified_base (320)..(320): a, c, t, g, unknown or other
  misc_feature (320)..(320): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggactccaggtggggatattgtgatgactcagtcctccactcctccctcgcccgtccacccgtggacgacgcccggcctccattcctcctgcaggttcacgccagactcctacttacagttagtaataggattacaacttagttagtaacttggtacctgacaagaacgccgaggacagtccaccgtanacgcctcgtgtacgttcgtttggtttcggtcgtaggtaccgttccggggtccccgttacccgggggtccttaggtacgtaacgggttccgaagggttcgggacgtaggggtacgttacgtccggaacgggacctaacgtaaggtttaccttttaacggacgttaaaggtaaacttacgggtaaggggttacggggtacgggtaaggtccggtaagggtagggtaaggttttggggttttaacgggtttagttaacggtcgtacgtagttaacggacttaaacgttactaaaccttaaacgtttacctaacgttaccggtttaccgggaaccggtaacgggaccggtaagtaccggtaggtaacgttaagaaccggtaaacgttaacgggttgtaacggtacctacggaaccctccttaaaccgtcgtttacccgg

SEQ ID NO: 280160 - DNA, 349 bp, Homo sapiens
  misc_feature: GYAE6OF01BAGXW.47.38.D05.1.454.CMB.1.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (337)..(349): a, c, t, g, unknown or other
  misc_feature (337)..(349): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcgtctcccctgccacctcncagncacngngggcangcgcctggctgctgtacaggactcttcctagngngctcgtggacgcgggctggcaaggcgacatagnnnnnnnnnnnnn

SEQ ID NO: 280161 - DNA, 376 bp, Homo sapiens
  misc_feature: GYAE6OF01CDBST.47.38.D05.1.454.CMB.1.raw
  modified_base (344)..(344): a, c, t, g, unknown or other
  misc_feature (344)..(344): n is a, c, g, or t
  modified_base (368)..(376): a, c, t, g, unknown or other
  misc_feature (368)..(376): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgtacgttttgatttggtcagttacccggacgtggtggggacaaagggaccacggtcaccgtctcctcagcctccaccgaacggcccatccggtccttccccctggcccaccctcctaccaagacgcaccgtcgtgggggcacaggcggccctgggctgcctggtcaaggactacttcctacgtgagctcngagcgggctggcaaggcgcatagnnnnnnnnn

SEQ ID NO: 280162 - DNA, 496 bp, Homo sapiens
  misc_feature: GYAE6OF01EPKJJ.47.38.D05.1.454.CMB.1.raw
  modified_base (480)..(496): a, c, t, g, unknown or other
  misc_feature (480)..(496): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgtcgttagttacggacgtatttacgtacgttttgatttggtctaacgttacccgggacgtggtggggacaaacgggaccacggtccacccgtcctccctcacgtccctaccgaaccgaacgggccccagttccccgggttccctttccccccgtcggccctacccccttccctaccaagacgcctacccgtcggtcggggcacgcggcccggccgtgggcctcgccgtggtacgaacggtaccttacgttcctagttcgttaattaccgtcgttggaccgggtcgggccgtagggaccgacggcgacgatagcnnnnnnnnnnnnnnnnn

SEQ ID NO: 280163 - DNA, 414 bp, Homo sapiens
  misc_feature: GYAE6OF01AWBAZ.47.38.D05.1.454.CMB.1.raw
  modified_base (368)..(414): a, c, t, g, unknown or other
  misc_feature (368)..(414): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggacaaagggaccacggtcaccgtctcctcagcctccaccaagggcccatccggtcttccccctggccaccctcctccaagacgcacctctgggggccaccagcggccctgggctgcctggtccaaggctacttcctacgtgagctctgacgcgggctggcaaggcgcatacgnnnnnnnnnnnnnnnnnnnnnnnnnnnnnnnnnnnnnnnnnnnnnnn

SEQ ID NO: 280164 - DNA, 709 bp, Homo sapiens
  misc_feature: GYAE6OF01B1JMK.47.38.D05.1.454.CMB.1.raw
  modified_base (184)..(184): a, c, t, g, unknown or other
  misc_feature (184)..(184): n is a, c, g, or t
  modified_base (545)..(545): a, c, t, g, unknown or other
  misc_feature (545)..(545): n is a, c, g, or t
tcagagctcacgtacacgaccggtgctcgatttagtatctgatagttgggtttgggggaggactcctcagttcaccttctcacaatgaggctccctgctcagctcctggggctgctaatgctctgggtctctggatccaggtggggatattgtgatgactcagtctccagtctccctgcccgtnatcgtggagcgccggcctccatcctcctgcaggtctacgccaggacgtcctccgtgcaagactaagtaggaaactaccttatttggatttcggtacctgaacaaaacgccgagggaccagtacctaccaacctaacctccgtagtacttacgtttaagttttcggttacttttaacggtcccggggtcccgttcccgggggtccctcgaacggttacggttacacgtcggcgtaggtacggtatcgacggtaccaacgttagttaactttttagaactttaagtaaactaccgtagaacagggtaacggtagggaggtacgaggacgtagtggtacgtttaggtacgtttttaagttacgntacgtagtacgaaccgaagttaacccgtaaaaccttaacccttcctttaaccctaccgggttaccgaaccggtaaccggaccgtaaccggacggttagaaccgttaacggttaaggaacccttaacgggttacggacggtacccgacgtaccctaaccgttacg

SEQ ID NO: 280165 - DNA, 608 bp, Homo sapiens
  misc_feature: GYAE6OF01ARWX4.47.38.D05.1.454.CMB.1.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
  modified_base (448)..(448): a, c, t, g, unknown or other
  misc_feature (448)..(448): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcgtggggctgaggtgaaagaagccgtggggcctcagtgaagtctctgcaaggcttcnggatacngcttcaccgactactatttgctacgtgggtcgcggaccgggcccctggacgaacgggtcttggagtggagtgggacggatccgagcccgtaagnggtggtcggacaacaaactntgacacaggtaggtttcgagggacagggtcacagtacgaccgaggacgacgtaccaagtacagtacacgacctanacgtaggagtcgtagacgtacgtacgtactaggacgtaccgtacgaaccgaccgccgggtacgttagttaagttacgttggtcggttaccggtttaaggttacccggtacgtaacgtttaaccggttagttttaggtagtttacgggtccgttaaccggg

SEQ ID NO: 280166 - DNA, 475 bp, Homo sapiens
  misc_feature: GYAE6OF01DZD8N.47.38.D05.1.454.CMB.1.raw
  modified_base (461)..(475): a, c, t, g, unknown or other
  misc_feature (461)..(475): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggcgtgtattattgtgtcgttagtacggacgtattacgtacgttttgattggtctacgttacccgggagttggtggggacaaaggggaccacgggtcaacccgtctcctcacgccctccaaccgaacggcccagtccggtccttcccccgtggcccacccctcctaccaagacgccaccgtcggtcggggcacgacggccgggcccgtgggtccgtcgtccggtacggtaccgaaacgggtaccttacttccgtacgtcgagtccgtcgtacggtacggcgggtcgtacggacgaacgggcgtacagtagnnnnnnnnnnnnnnn

SEQ ID NO: 280167 - DNA, 421 bp, Homo sapiens
  misc_feature: GYAE6OF01A9F8V.47.38.D05.1.454.CMB.1.raw
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (411)..(421): a, c, t, g, unknown or other
  misc_feature (411)..(421): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagtacggacgattacgtacgttttgattggtcagttacccggacgtgtggggacaaagggaccacggtcaccgtctcctcacgcctaccaccgaagggcccatccggttccttccccctggccaccctccctaccaagacgccaccctcgtcgggggccacgacgccggcccgtggctcgccgtggtccaaggacttacttccgtacgtgacgctcgagnggcggctggcaggcncatgnnnnnnnnnnn

SEQ ID NO: 280168 - DNA, 524 bp, Homo sapiens
  misc_feature: GYAE6OF01DIL18.47.38.D05.1.454.CMB.1.raw
  modified_base (282)..(282): a, c, t, g, unknown or other
  misc_feature (282)..(282): n is a, c, g, or t
  modified_base (478)..(478): a, c, t, g, unknown or other
  misc_feature (478)..(478): n is a, c, g, or t
  modified_base (485)..(486): a, c, t, g, unknown or other
  misc_feature (485)..(486): n is a, c, g, or t
  modified_base (488)..(524): a, c, t, g, unknown or other
  misc_feature (488)..(524): n is a, c, g, or t
tcagagctcacgtacacgaccggtgctcgatttagtatctgatagttgggtttgggtgcccaagctgctggagggcacggtcaccacgctgctgagcagtctgagacctgacgacacggcctgtatttattgtgtacgttagttacggacgtattacgtagttttgattggtactacgttacccgggagtggtggggacaaacgggccacggtccaccgttcctcctacacgcctaccgaaccgaacgggcccctaagttcccgggtccctttcccccccgnggcccctacccccttacctacccgaaaacgggtcgaacccgtaccccgttcgggcgggggggacccaaaccggacggttcccgggccccggttggggcttcggacccgttagggtaccgaaacgggtacctttacccttaccgtaaccgttggaactcctccgtaaggcggttccggccgtagggaccaacgggcnaaaggtnngnnnnnnnnnnnnnnnnnnnnnnnnnnnnnnnnnnnnn

SEQ ID NO: 280169 - DNA, 498 bp, Homo sapiens
  misc_feature: GYAE6OF01AR3B2.47.38.D05.1.454.CMB.1.raw
  modified_base (207)..(207): a, c, t, g, unknown or other
  misc_feature (207)..(207): n is a, c, g, or t
  modified_base (470)..(470): a, c, t, g, unknown or other
  misc_feature (470)..(470): n is a, c, g, or t
  modified_base (486)..(498): a, c, t, g, unknown or other
  misc_feature (486)..(498): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaaactatgcacagaggtttcagggcagggtcaccatggaccagggacacgtccatcagtacagcctacatgganctgagcagtctgagacctgacgacacggccgtgtattattgtgcgttagttacggacgattacgacgttttgattggtcattacccggagtgtggggcaaagggaccacggtcaccgtctcctcagcctccaccaagggcccaatcggtccttccccctggccaccctccctccaacgacgcaccgtacgtcgggggcacgacgcggccctgggctcggcctggtcaaggctacttcctacgtcgagtctctgaggcgggtcnggcgaggcgcatagcnnnnnnnnnnnnn

SEQ ID NO: 280170 - DNA, 444 bp, Homo sapiens
  misc_feature: GYAE6OF01DIQWM.47.38.D05.1.454.CMB.1.raw
  modified_base (300)..(300): a, c, t, g, unknown or other
  misc_feature (300)..(300): n is a, c, g, or t
  modified_base (407)..(444): a, c, t, g, unknown or other
  misc_feature (407)..(444): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgtttttgattggtcattacccggagtggtggggcaaagggaccacggtcacccgtctcctcacgccctccaccaagggcccactccggttcccttcccccctggccacccctcctaccaagacgccacctcgtgggggcaacncggccggcccgtgggctacggccgtggtacaaacggtaccttacgtttacccgtacgtggacgtcctcgtggacggtcgggctcgggacgaagggccgacagtagannnnnnnnnnnnnnnnnnnnnnnnnnnnnnnnnnnnnn

SEQ ID NO: 280171 - DNA, 398 bp, Homo sapiens
  misc_feature: GYAE6OF01BJ8P8.47.38.D05.1.454.CMB.1.raw
  modified_base (380)..(385): a, c, t, g, unknown or other
  misc_feature (380)..(385): n is a, c, g, or t
  modified_base (387)..(398): a, c, t, g, unknown or other
  misc_feature (387)..(398): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgtttttgattggtcattacccggacgtgtggggcaaagggaccacggtcaccgtctcctcagcctccaccgaagggcccatccggtccttcccccctggccacccctcctacccaagacgccacctcgtggggggcacacgccggccctgggctgcctggtcaaggactactttcctacgtgacgctctgaggcgggctggacaggcgcagtacgnnnnnnannnnnnnnnnnn

SEQ ID NO: 280172 - DNA, 519 bp, Homo sapiens
  misc_feature: GYAE6OF01BE7PQ.47.38.D05.1.454.CMB.1.raw
  modified_base (423)..(424): a, c, t, g, unknown or other
  misc_feature (423)..(424): n is a, c, g, or t
  modified_base (426)..(427): a, c, t, g, unknown or other
  misc_feature (426)..(427): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (475)..(476): a, c, t, g, unknown or other
  misc_feature (475)..(476): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagcctgacgacacggcgtgtattattgtgcgttagttacggacgtattacgacgttttgattggtcattaccggagtgtgggaacaaagggccaacggtcaccggtctcctcgagcctccgaaccgaagggccatccggtctccctgcaccctctaccaagacgccaccgtcgtggggcacgacggccggcccgtgggctacggtccgtggtaccaacggtacttacgttccgtacgtgacgtcgtaccgtggacggcgggcgtcggacgaaggcgacgagtaaggnngnnagnacgtncgtacngacatgatgctgcagcanctaagntacancgngnngcngacgactgacngngacgcnacngagngatncgncngngng

SEQ ID NO: 280173 - DNA, 534 bp, Homo sapiens
  misc_feature: GYAE6OF01A2RWE.47.38.D05.1.454.CMB.1.raw
  modified_base (503)..(534): a, c, t, g, unknown or other
  misc_feature (503)..(534): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgttgtatttattgtgtcgtttaggttacggacgtatttacggtacgtttttgatttggtactaacgtttaccccgggacgtggtgggggacaaaggggacccacgggtccacccgttctcctcacgccctacccaccgaacggggccccagttccggtcccttccccccgtcggccctaccccgttccctaccgtaagacgcctaccccgttccggtcgggggccaccgacggccgggccccgtggggcctcggccgttagggtacgaacggtaccttaccgtttaccgtacgtggacgtccgttcgtggacgggcggggtcgtcgggaccgaagggccgacagtacgnnnnnnnnnnnnnnnnnnnnnnnnnnnnnnnn

SEQ ID NO: 280174 - DNA, 497 bp, Homo sapiens
  misc_feature: GYAE6OF01AT0ID.47.38.D05.1.454.CMB.1.raw
  modified_base (305)..(305): a, c, t, g, unknown or other
  misc_feature (305)..(305): n is a, c, g, or t
  modified_base (435)..(435): a, c, t, g, unknown or other
  misc_feature (435)..(435): n is a, c, g, or t
  modified_base (461)..(497): a, c, t, g, unknown or other
  misc_feature (461)..(497): n is a, c, g, or t
tcagagctcacgtacacgaccggtgctcgatttagtatctgatagttggggtttgggtgcccaagctgctggagggcagggtcaccatgaccgagggacacgtccatcagtacagcctacatggagctgagcagtcctgagacctgacgacacggccgtgtattattgtgtcgttagtacggacgattacggtacgttttgattggtctacgttacccggacggttggtcggggacaaaggggccacgggtccaccgtcctcctcgagccctccgaaccgaacgggcccatccggtcttcccccnggccaccctcctcacgcgccaccgtcgtgggggaccacgacggtccggcccgttggggcctcggacccggttgggtacaaacggtaccttaaccgttccctaaggtcggacgtcctactggacggcgggngtacggacggaggcccggactagtgnnnnnnnnnnnnnnnnnnnnnnnnnnnnnnnnnnnnn

SEQ ID NO: 280175 - DNA, 596 bp, Homo sapiens
  misc_feature: GYAE6OF01CB0DT.47.38.D05.1.454.CMB.1.raw
  modified_base (302)..(302): a, c, t, g, unknown or other
  misc_feature (302)..(302): n is a, c, g, or t
  modified_base (474)..(474): a, c, t, g, unknown or other
  misc_feature (474)..(474): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccgcctccatcctcctgacaggtctagccaagcgcctctgcagtactatgaaatcctattgattggtacctgcaaaagccaggctacgtctacacaactccnagtctagttgtactttaagccggtccgtccggggtcctgactacggtcagtcggacgagtggactccgaaggtccaacgtacggttattttaacaagttagaaacgtcgagacctaggtagtgggaacgctacgacgtagtacgtcgttaggtaactttacttacgtacgtntaacgtccgactaacgtaaccttaaacaccggtttcctaccgtaccgttcggaaccgtaagggactacggacgttacggactacggtttaacgaacgtaacgttaggtacgctcgtaacccg

SEQ ID NO: 280176 - DNA, 761 bp, Homo sapiens
  misc_feature: GYAE6OF01CTZTS.47.38.D05.1.454.CMB.1.raw
  modified_base (294)..(294): a, c, t, g, unknown or other
  misc_feature (294)..(294): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccaggtggggatattgtgatgactcagtctccactcctccctcgcccgtccgacccccgtggacgcgcccggccctccactccttccgtgcgtacggtctacgcccgaagtcgcccttcttaacattaggttaatggtactttaccaaattagttttnaaagtttcggttacctgacgaagaacgccgagggtccacggtccctaccacgaccgtcctaccgtgtattcgttttgggttttgggttcctaggtccgggtcccgggtcccggttcccggggtacctacggtacggtcgggttacgagggtggacgtggttagggcgttaacggcggtacgtacgttaaggtttacgtttaccgagtaacgtaaacgtcggtaaggggtaggggtaggaagggtcggtagggtaggttaggtttcggggttttaggtttaacgttgtacgtgtagtcggtaacgttacgttaccttaaccgttaaaccgtttccctttaccgtttaacgggttttcccgggaacccgggttaaccggaacggtaccggtacggtacggtaaacggtactaaaccggtaacggtacgttcgggtacgacgtacgaccctacgtcgttcgttaacccgg

SEQ ID NO: 280177 - DNA, 492 bp, Homo sapiens
  misc_feature: GYAE6OF01BPGGM.47.38.D05.1.454.CMB.1.raw
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (447)..(492): a, c, t, g, unknown or other
  misc_feature (447)..(492): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgtatttacgtacgtttttgattgggtcagttacccgggagtggtggggacaaaggggccacggtccaccgtctcctcagcctccaccaagggcccatcggtccttccccctggcccaccctccctccaagacgccacctcgtcgggggcaccgacggccggcccgtgggcctgccgtggtacaacggtaccttaccgttcccgtaacgtggacgtcctcgtggacggtccgggcgtcgggcaagggccgctaagtaggnangctannnnnnnnnnnnnnnnnnnnnnnnnnnnnnnnnnnnnnnnnnnnnn

SEQ ID NO: 280178 - DNA, 667 bp, Homo sapiens
  misc_feature: GYAE6OF01APEPM.47.38.D05.1.454.CMB.1.raw
  modified_base (205)..(205): a, c, t, g, unknown or other
  misc_feature (205)..(205): n is a, c, g, or t
  modified_base (612)..(612): a, c, t, g, unknown or other
  misc_feature (612)..(612): n is a, c, g, or t
  modified_base (620)..(620): a, c, t, g, unknown or other
  misc_feature (620)..(620): n is a, c, g, or t
  modified_base (658)..(658): a, c, t, g, unknown or other
  misc_feature (658)..(658): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatgganctgagtcagtctagacgaccgtgacgacacggccgtagtattatgtgtcgttagttacggacgtattacgtacgttttgagttcggtcgtacttacccggtagttggtacggggacaaaacgggccgaacggtcacccgtactccgtcacgtccctccaaccgaggccctagtccggtccttccccgcggccaccctcctaccgaagacgccctacgttaccgtcggggtaccaccggtacgcccgggtacccgtcgggtcctcgggtaccccgttcgggtaccctaaaggtaccccgtttaccgttacccggttaaccggtacggtaaccggtccttaccggttacggaccggggtccgggacgttacgggtaacggaacgggtcccgtaacgtaaacggtcgganccggtacngacgcgacgcgtagacgtcgtacgagtcgtactacacnctcgtctcg

SEQ ID NO: 280179 - DNA, 673 bp, Homo sapiens
  misc_feature: GYAE6OF01E5PO3.47.38.D05.1.454.CMB.1.raw
  modified_base (328)..(328): a, c, t, g, unknown or other
  misc_feature (328)..(328): n is a, c, g, or t
  modified_base (400)..(400): a, c, t, g, unknown or other
  misc_feature (400)..(400): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggattattgtgatgactcagtctccactctccctcgcccgtcaccccgtggagacgcccggcctccacgtcctcctcgctaggtctacgccaggacgtccttcttaacagttaagtaatggtattactaacttatttagaagttcggtacctgacgtaaggaacgccggaggcagtcctaccacncgcctccgtgtacgtcgtttggtttggttctgtacggtccgggtccgtccgggtcgtacgacgtaggttacnggtacgacgtaggtggtactcgaagctacgtaagttacgtttacgacgttaaagtaacgtacggtagggtaaggggtacggacggtacggtagggacggtttaggtttacggggttttaggtttacttacgtgtacgtagtcgtaacgttaacgttacttaacgtaacctttaccgtacgtttaccggttaggaccggaacgggtacgacgcggtagtacgaagtaaccgtaaacggtacgtcggtcgacgtacgacctacttgtccgtttcg

SEQ ID NO: 280180 - DNA, 662 bp, Homo sapiens
  misc_feature: GYAE6OF01CXE27.47.38.D05.1.454.CMB.1.raw
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
tcagagctcacgtacacgaccggtgctcgatttagtatctgatagttgggtttgggtgcccaagctgctggaggggcacggtcaccacgctgcttgagtggatgggacggatcagccctaacagtggtggcacaaactatgcacagaggtttcagggcagggtcaccatgaccagggacacgtccatcagtacagcctacatgggagctgagcagtctgacgacctgacgacacggcgtagtattattgtgtacgttaagttacggacgtagttaacgtacgttttgattggtactacgttaccggacggtaggtcggggacgaacgggaccgacggtcaccgtctcctcacgcctaccgaccaacggccacgtccgtcccttccccgtggacccaccccgtacctaccgaaacgacgtccgtaacccgttcggtcgggggacctaccggaaccggtccgggtaccccgtcggggtaccgtcggtccccgttacgggtaaccgtaaaaccgggttcccggtttaaccctttacccggttaacggttacggacccgttccggttaccggtacggtacgggcccgggggtacgtccggggtaacgaacgggaccgaccgtaaagtacgngagtacngcnagacagcgncngcnanancngngng

SEQ ID NO: 280181 - DNA, 573 bp, Homo sapiens
  misc_feature: GYAE6OF01BEEZ0.47.38.D05.1.454.CMB.1.raw
  modified_base (339)..(339): a, c, t, g, unknown or other
  misc_feature (339)..(339): n is a, c, g, or t
  modified_base (553)..(573): a, c, t, g, unknown or other
  misc_feature (553)..(573): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcaacaaactatgcacagaggtttcagggcagggtcaccatcgaccagggacacgtccatcagtacagcctacatggagctgagcagtctgagacctgacgacacggccgtgtattattgtgtacgttagttacggacgtattacgtacgttttgattggtctagttacccggagtggtcgggacgaaacggccacggtcaccgtctcctnacgtcctaccaccgacggcccacgtccggtcccttcccccgtcggccctacccctcctaccgaacgacgccctaaccgtcggtacgggggtaccacgaacggcccggtcccgtcgggtcctcggtcccgtcgggtactaacggtaccttaccttccgtacgtcgacgtcgtcgtgacgggcggtcgtcgggacgaagggccgtaacgagtacgnnnnnnnnnnnnnnnnnnnnn

SEQ ID NO: 280182 - DNA, 599 bp, Homo sapiens
  misc_feature: GYAE6OF01EPT47.47.38.D05.1.454.CMB.1.raw
  modified_base (579)..(579): a, c, t, g, unknown or other
  misc_feature (579)..(579): n is a, c, g, or t
  modified_base (581)..(584): a, c, t, g, unknown or other
  misc_feature (581)..(584): n is a, c, g, or t
  modified_base (586)..(599): a, c, t, g, unknown or other
  misc_feature (586)..(599): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccgagggacacgtccatcagtacagcctacagtggagctgagcgagtctgacgacctgacgacgaccggccgtagttattattgtgtacgtttaggttacggacgtattacgtacgttttgattgtactacgttacccggagtggtcgggacgaaacgggaccgaccggtccgaccgtctcctcacgccctacccaaccgaacggccctacgtccggttcccttcccccgtcggccctacccctccctaccgaacgacgcccgtaaccgtcggtcggggaccacggaccggccggcccgtcgggctcggccgtacgggacaaacggtaccttacgttcccgtaggtcgacgtccgtcgtacggtacgggccggtcggtacggaccggaagggccgtacgtaagcgtgcngnnnngnnnnnnnnnnnnnn

SEQ ID NO: 280183 - DNA, 538 bp, Homo sapiens
  misc_feature: GYAE6OF01BWXQA.47.38.D05.1.454.CMB.1.raw
  modified_base (445)..(445): a, c, t, g, unknown or other
  misc_feature (445)..(445): n is a, c, g, or t
  modified_base (477)..(538): a, c, t, g, unknown or other
  misc_feature (477)..(538): n is a, c, g, or t
tcagagctcacgtacacgaccggtgctcgatttagtatctgatagttggggtttgggtgcccaagctgctgggagggcacggtcaccacgctgctgagcagtctgagacctgacgacacggccgtgtattatggtgcgttagtacggacattacgacgttttgattggtcagttacccggagtggtgggggacaaaaggggccaacgggtcaccggtctcctcgacgccctaccaaccgaaacggggtccccaagttccgggtccctttccccccgtgggacccaccccttaccgtaccgaaaaggcggtacctaccgtcggtacgggggggaccaacgtagggccggccccgttgggggccttgcccgttaggggtccaaaacggggtaccttaacctttcccgtaacgggttgaacggtctccgttaggacggtcggggtccngggacccaaagggccggattaagtaaggcagnnnnnnnnnnnnnnnnnnnnnnnnnnnnnnnnnnnnnnnnnnnnnnnnnnnnnnnnnnnnnn

SEQ ID NO: 280184 - DNA, 837 bp, Homo sapiens
  misc_feature: GYAE6OF01BIMH6.47.38.D05.1.454.CMB.1.raw
  modified_base (351)..(351): a, c, t, g, unknown or other
  misc_feature (351)..(351): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccgaggtgggatattgtgatgactcagtcctccactcctccctcgccccgtccaccccgtggacgacgcccggcctccatcctcctgctaggtctacgccagcgtcctactaacaagtagtaagtggtacttacaaactttagtttagtaagtttacggtaacctggacaacggaagcccgaggggcctacggtcctaccgacacgtcctcgtanacgttcgtttcggtttcggttctcggtacgggttcccgggtcccggttcccgggggtacctacggtaaccgtggttaccgagggttacggacgtacggtaggacgtaaccggtacggactaacgtacggttttaacgtttacggtaacgtaacggttaaaacggttacgggtaaacgggttaggggtacgggtaacggttacgggtaaggggttaacgggtttaagggtttttaggggttttaacgggttttaagttacggttacggtaacgtaaggtttacccggtaacgtttaaacccggtttaaccttaaaccgggttaaaccccttttaacccggtttaacggtttaccccgggttacgggtaacccgggttaaacgggggaacccttaaacgtaccgggttaagggtacgttaaaccgtaacgtaaaacgggtacgttacggtacgttcgaaccgtacccgtacttaacgtcggtttaccc

SEQ ID NO: 280185 - DNA, 710 bp, Homo sapiens
  misc_feature: GYAE6OF01E5BKF.47.38.D05.1.454.CMB.1.raw
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
tcagagctcacgtacacgaccggtgctcgatttagtatctgataggttgggtttgggggaggactcctcagttcaccttctcacaatgaggctccctgctcagctcctggggctgctaatgctctgggtctctggatccaggtggggattattgtgatgactcactcctcccacttcctcccgtcgcccgtccaccccgtggacgcgccgcctccactcctcctgcacggtctacgccagacgtcctactacaattaagtaagtgtactactaactttagtttagaattcggtacngacgaggacgccgaggactacgtcctaccactcnccgttaccgttgttacgttccgtttgggtttccggtcgtaccggtaccggtcccggggtacccggtccgggttaccaggtacgtacggttacgaggtcgacgtcggtacgtactacggacggtacctaaggtaacgttaacgtttacgaacggtaaagtaacggtcgggtagggtaagggtggtacgtggttagggtaggtttggtttagggtttagttaacgtagtcgtacgtacgtaacgttaccgttaaacttaccctaaccgtttaaccgttaccgtacggttacggtaccggaccggtaaaggtctaaccggtaggaacgtaacgtacgaaaccgtacggtgttcgcgtaccgtctaaccctcttcgtctttccg

SEQ ID NO: 280186 - DNA, 787 bp, Homo sapiens
  misc_feature: GYAE6OF01A5Z68.47.38.D05.1.454.CMB.1.raw
  modified_base (143)..(143): a, c, t, g, unknown or other
  misc_feature (143)..(143): n is a, c, g, or t
  modified_base (391)..(391): a, c, t, g, unknown or other
  misc_feature (391)..(391): n is a, c, g, or t
  modified_base (458)..(458): a, c, t, g, unknown or other
  misc_feature (458)..(458): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctnttcttggtgcagcagccagaggacgtccactcccagttgcaacgtgtgcagtcgtgggctgaggtagaagaaggccgtggggcctagaggtgaaggttcctaccgtaggaccgtaaggtcttcgtaggtacttaacgacgtaccttccgaaccgtacttacgttaagtttcgaccgtacggttggggtacgaccggggacccgggtacccccggttaggaaccgggtaacggggtccgttttaagggngggttaacgggtaacgggttaaccgggggacggtaacgtacccgtaaccggtcccggttaaaacggnggttacgggtacgaacccgtaaactaaaacggttcgtaccggaacgtaacgtaggttacgggtttacggacggggtaccgtaacggggttacccaacgttaaccgtaaccgggacggtaaaccgggaactaccggtaaccgtaataaccggtacgtaaccgacgtaaccccgtatacggtacgaacgtacgtacggctaccgtaacggtctaacgggaactaccgtaagacgaacgtaccgttccggtaagtttacttgttcggtagtacgttcgggaaacgttacgtacgtttacgttacgttaggtacttcgggttaccgtaaacgg

SEQ ID NO: 280187 - DNA, 176 bp, Homo sapiens
  misc_feature: GYAE6OF01CIGCX.47.38.D05.1.454.CMB.1.raw
  modified_base (174)..(176): a, c, t, g, unknown or other
  misc_feature (174)..(176): n is a, c, g, or t
tcagagctcacgtacacgaccggtgctcgatttagtatctgatagttgggtttgggggaagaggaagactgacggtcccccaggagttcaggtgctgggcacagcggccctgggctgcctggtcaaggactacttcctatgtatactctgagcgggctggacaaggcgcatagnnn

SEQ ID NO: 280188 - DNA, 613 bp, Homo sapiens
  misc_feature: GYAE6OF01BT747.47.38.D05.1.454.CMB.1.raw
  modified_base (279)..(279): a, c, t, g, unknown or other
  misc_feature (279)..(279): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (568)..(570): a, c, t, g, unknown or other
  misc_feature (568)..(570): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(600): a, c, t, g, unknown or other
  misc_feature (598)..(600): n is a, c, g, or t
  modified_base (602)..(602): a, c, t, g, unknown or other
  misc_feature (602)..(602): n is a, c, g, or t
  modified_base (605)..(606): a, c, t, g, unknown or other
  misc_feature (605)..(606): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
tcagagctcacgtacacgaccggtgctcgatttagtatctgatagtttgggtttgggtgcccaagctgcgtggagggcacggtcaccacgctgctgagcagtctgagacctgaacgacgacggcgtgttattagttgtgtcgttagtacggacgtatttacgtacgtttttgagttcggtctacgttacccggagtggtcgggacaaacgggcccacgtccgaccgtctcctcgacgccctaccgaccgaacggcccagttcccggtcccttcccccgnggcccacccgtgacctacgaggcgactacccgtggtcgggaccaacgtcggcccggtcccgtaggtccgttaggcccgttacggtaaccgtaaacggtacccttttacccgtttaccggtaaggtgaccggttccgttaccggaaggggcccgggtcccggggttgacccggggtaaactaacgggggaccctaaggtaactacggngagagcgntntagngngtgcgacgtcgtacgtacgagagtcgtgacgngagtcgngcgcgctagcgcgngngangngacgannnctncncngacganantnntngagnantnnntntanntcngngn

SEQ ID NO: 280189 - DNA, 662 bp, Homo sapiens
  misc_feature: GYAE6OF01AJ2JB.47.38.D05.1.454.CMB.1.raw
  modified_base (642)..(642): a, c, t, g, unknown or other
  misc_feature (642)..(642): n is a, c, g, or t
  modified_base (644)..(662): a, c, t, g, unknown or other
  misc_feature (644)..(662): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaaactatgcacagaggtttcagggcagggtcaccatgaccagggacacgtccatcagtacagcctacatggagctgagcagtctagagcctgacgacacggccgtgtattattgtcgtacgttagtacggacgtaatttacgtacgttttagtagttcggttacctaacgtttaccccgggtacggtagggttacggggaacgaaaaacgggtacccgacggtaccgaaccggttcctcccgttaccacgcccctacccgaacccgaaaacgggcccctaacgtccgggttcccctttaccccccgtcggccccgacccccttacctacccgaaacgacgaccctaacccgtcggttacgggggaccaacgaacggcccgggtaccccgttaggggccgtcggtcccgttacgggtaaccgaaacccgggtaactttacccgttacccgtaacggttcgagtcccttcgtcggacgggccggacgtcggaacgaagggcgacacgtagnannnnnnnnnnnnnnnnnnn

SEQ ID NO: 280190 - DNA, 502 bp, Homo sapiens
  misc_feature: GYAE6OF01CM53J.47.38.D05.1.454.CMB.1.raw
  modified_base (462)..(463): a, c, t, g, unknown or other
  misc_feature (462)..(463): n is a, c, g, or t
  modified_base (465)..(502): a, c, t, g, unknown or other
  misc_feature (465)..(502): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgtcgttagttacggacgtattacgtacgttttgattggtcagttacccggagtggtgggggacaaaggggcccacgggtccaccgtctcctcacgcctccaccgaacggggccctagttcccggtcctttccccccgtggcccacccttccctaccaagacgccaccgtcggtgggggccacgacgccggccgtgggcctcggccgtcgggtacgaacgggtaccttaccgttcccgtacggtgaacgtccttacgtcggacgggccgggtacgtcggacgaacggcgcagtaggnngnnnnnnnnnnnnnnnnnnnnnnnnnnnnnnnnnnnnnn

SEQ ID NO: 280191 - DNA, 842 bp, Homo sapiens
  misc_feature: GYAE6OF01BF33D.47.38.D05.1.454.CMB.1.raw
tcagagctcacgtacacgaccggtgctcgatttagtatctgatagttgggtttggggaggactcctcagttcaccttctcacaatgaggcctccctgctcagctccgtggggctgctaatgctctgggtctctggatccgaggtggggattattggtgatgactcagtcctccactcctccctcggccccgtccaccccgtgggacgacggcccggtaccctcccattcccgttccgtggaccgtacgggttacctacggacccgaggtaccgtccccttactttaacgaagtttaagtaaagttggtaactttaccgaaaacttttacgttttagaacgtttcgggtaaccctggacgaaaggaacgggacccggagggcctacgttccgtacccacgtacgtccctttaccgtgtacgtttccgtttagggtttttcggggtcttcggtacccgggttcccggggtcccccggtttacccgggggttccctagggtaacccggttacggggttaccgtaagggttcgggaccgttagggtacggtacgtacggacggtctaacgttacgtttacgttttacgacgttaaagaaacgttggtaagggtacggggtaggacggtcggtaggtaggttcggtttagggtttacgggttttataccgtgtacgtagtaggtaacctttagttaaccttaaccgttaccgttttcccttaacgggttaccgtttacggggaacccggaacgggttacccagggttaaccggtaggaacgtaacgtaaccggttaaacggaccggttggtacgggtactaccgacctacgttacttcgtttacccg

SEQ ID NO: 280192 - DNA, 439 bp, Homo sapiens
  misc_feature: GYAE6OF01EFBV3.47.38.D05.1.454.CMB.1.raw
  modified_base (281)..(281): a, c, t, g, unknown or other
  misc_feature (281)..(281): n is a, c, g, or t
  modified_base (397)..(439): a, c, t, g, unknown or other
  misc_feature (397)..(439): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgttattattgtgcgttagttacggacgattacgagttttgattggtcattacccggacgtggtggggcaaagggaccacggtcaccgtctcctcacgccctccaccgaacgggccccagtccggtccttcccccgtggccacccctcctaccaagacncacctcgtggggccacgcggccggcccgtgggctcgccgtggtacgaaggtaccttaccttccgtacggtgacgtcgtctggacgggcgggcgtaggcgaacggcgtacagtaggnnnnnnnnnnnnnnnnnnnnnnnnnnnnnnnnnnnnnnnnnnn

SEQ ID NO: 280193 - DNA, 431 bp, Homo sapiens
  misc_feature: GYAE6OF01BRLNH.47.38.D05.1.454.CMB.1.raw
  modified_base (398)..(431): a, c, t, g, unknown or other
  misc_feature (398)..(431): n is a, c, g, or t
tcagagctcacgtacacgaccggtgctcgatttagtatctgatagttgggtttgggtgcccaagctgctggagggcacggtcaccacgctgctgagcagtctgagacctgacgacacggcgtgtattattgtgcgttagttacggacgattacgtacgttttgattggtcattacccggacgtggtggggcaaagggaccacggtcaccgtctcctcacgcctaccaaccaagggcccatccggtccttcccccgtggccacccctcctaccaagacgccaccgtcggtcgggggacaacgacgccggcccgtggctcgccgttggaacaacggaccttaaccgttccgtacgtgaacgtcctacggtgacggcgggacgtggacgaaggcacatgannnnnnnnnnnnnnnnnnnnnnnnnnnnnnnnnn

SEQ ID NO: 280194 - DNA, 802 bp, Homo sapiens
  misc_feature: GYAE6OF01DDA9O.47.38.D05.1.454.CMB.1.raw
  modified_base (178)..(178): a, c, t, g, unknown or other
  misc_feature (178)..(178): n is a, c, g, or t
tcagagctcacgtacacgaccggtgctcgatttagtatctgatagttgggtttgggtgatcaggactcctcagttcaccttctcacaatgagctccctgctcagctcctgggctgctaatgctctgggtctcgtggactccgaggtgggtattattgtgatcgactcacgtcctaccncctcctcccgtcgccccgtccaccccgtgagaccgcccgccctcactcctccgtgcgtacggtctacgaccgaagtctcccttactttacaattaaacggttagtacggttaacttacctaaagttagtttagtaaacgttttcggtacctggaccgaacggaacgcccggtaaggtctacgttcccaccgaacgcgtcctccgtagtctttcggttggttacggttcacggtccgttcccgggtcccgttcccgggttacccgaggtaaccgtttggttaccgagggttaccggcgttaagggtaccgtaagtccgtaacgggacctaacggttacgttaaccgtttaacggtaacgtaaaacgtaaacgttaggtaacgggtaaggggtcggtacgtacggtaagggtaacggttaggttttacggggttttagggttaccgtttaacgtcgggttacgtaacgttaccggttaacgtaacggtttaaccctaaaccgtttaacctttacgtaacccgttttacgtacccgggtacgtaacccggggtaactaccggtaggttaacggaacgtaaacgtaccgtaaaacgttcggtacgtggtaacctcggtaaccctaccg

SEQ ID NO: 280195 - DNA, 395 bp, Homo sapiens
  misc_feature: GYAE6OF01C2OTR.47.38.D05.1.454.CMB.1.raw
  modified_base (381)..(395): a, c, t, g, unknown or other
  misc_feature (381)..(395): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggcgtgtggggcaaaggggccacggtcaccgtctcctcagcctccaccaagggcccatcggtcttccccctggcaccctcctccaagagcactctggggcacagcgccctggctgcctggtcaaggactactcctatgtatactctgagcgggtctggcaaggcgcatagnnnnnnnnnnnnnnn

SEQ ID NO: 280196 - DNA, 383 bp, Homo sapiens
  misc_feature: GYAE6OF01DP4J3.47.38.D05.1.454.CMB.1.raw
  modified_base (369)..(383): a, c, t, g, unknown or other
  misc_feature (369)..(383): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggagtgtggggcaaagggccacggtcaccgtctcctcagcctccaccaagggcccatccggtcttccccctgaccacccctcctaccaaaggacgcacctctcgggggcacagcggcccctgggctgcctggtcaaggactacttcctagtgacgcctgaggcgggctgggacaaggcgcatagnnnnnnnnnnnnnnn

SEQ ID NO: 280197 - DNA, 452 bp, Homo sapiens
  misc_feature: GYAE6OF01ATQ4I.47.38.D05.1.454.CMB.1.raw
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (394)..(452): a, c, t, g, unknown or other
  misc_feature (394)..(452): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgtttttgattggtcatttaccccggagtggtggggcaaagggaccacgggtcaccgtctcctcagcctccaccaagggcccatccggtccttccccccnggccaccctcctccaagacgcacctntgggggcacagcggccctgggctgccctggtcaacggacctacttccgtaacgtcggtagcttccgnggaggccgggtctcggccgaaagggccggtactaagtagngntcnnnnnnnnnnnnnnnnnnnnnnnnnnnnnnnnnnnnnnnnnnnnnnnnnnnnnnnnnnn

SEQ ID NO: 280198 - DNA, 789 bp, Homo sapiens
  misc_feature: GYAE6OF01CGQTM.47.38.D05.1.454.CMB.1.raw
  modified_base (438)..(438): a, c, t, g, unknown or other
  misc_feature (438)..(438): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccgaggtggggatattgtgatgactcagtctccactcctcccgtcgcccgtaccacccgtggagcgcccggcctccacttcctcctggtccgaggtcacgcagacgtcctatacatagtaagtgattactaattagttgaacgttcggtactggacaagaacgccgaggctacgtccaccgacgctcctccgtgtactttcgttggtttacgggttctacggccggttccgggtcccggttaccgggggtccttaggaacggttcgggttaccgtaggtcgggacgtagggtacggtaaccngggaacggtccgtaaacgttaacggttttaacgttttacccggaaggttaaacggtaaacgttacgggtaacggggttaagggggtaacgggtacgggtacggtagggttaaggggtttagggttttcggggtttttaagggtttaacgtttacgtacggacgttaggtacgttaaccgttaaaccgtttaaccgtaacctttaaaccgtttaccgttaaccgtttcggttacggaccgggtaacgggtacccgtaacggtagtagggtaaaccgtaaggtaaacccgtaaacggttacggttaggtaccggtactacccggttaacctaaccgttcgttaccggtttacc

SEQ ID NO: 280199 - DNA, 718 bp, Homo sapiens
  misc_feature: GYAE6OF01EITZ3.47.38.D05.1.454.CMB.1.raw
  modified_base (259)..(259): a, c, t, g, unknown or other
  misc_feature (259)..(259): n is a, c, g, or t
  modified_base (370)..(370): a, c, t, g, unknown or other
  misc_feature (370)..(370): n is a, c, g, or t
  modified_base (522)..(522): a, c, t, g, unknown or other
  misc_feature (522)..(522): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggacgtccactcccagttgcaacgtggtgcagtcgtggggctggaggtgaagagccgtgggcctcagtgacggtctcctgcaggtcttgtgatcngcttcacgtactactattgctacgtgggtcgccggaccgggtccctagggaccgtaacggggtcttaggaggttaggacgtggggacgtacgtcgacggtcccctaaaggnggttacgggtaggaccaaaccgtaaacgttacgtcgactaccggtaggttacgggttacgagggccgtacgggttaccaacccgttagaccggaacggacgggaaccctaccggtaccagttaacccgaagtacctacggtaccgttaacgnggttacgggactaccgtacgtaagaacccgtaggttccgtagggaaacctcccgtaagggaccgaccggtaccggttccgggtttaattaaggttttacgttcgggtacgtttaacgggtttaaacggtacccggttaattaaccgggttttacgttagggtttttagcgttttacgggaccgttttaaacccggg

SEQ ID NO: 280200 - DNA, 562 bp, Homo sapiens
  misc_feature: GYAE6OF01DDOPL.47.38.D05.1.454.CMB.1.raw
  modified_base (508)..(509): a, c, t, g, unknown or other
  misc_feature (508)..(509): n is a, c, g, or t
  modified_base (513)..(521): a, c, t, g, unknown or other
  misc_feature (513)..(521): n is a, c, g, or t
  modified_base (523)..(528): a, c, t, g, unknown or other
  misc_feature (523)..(528): n is a, c, g, or t
  modified_base (530)..(562): a, c, t, g, unknown or other
  misc_feature (530)..(562): n is a, c, g, or t
tcagagctcacgtacacgaccggtgctcgatttagtatctgatagtttgggtttgggtgcccaagctgctggagggcagggtcaccatgaccagggacacgtccatcagtacagcctacatggagctgagcagtctgagacctgacgacgacggccgtgtattattgtgtcgtttaggttacggacgtatttacgtacgtttttgatttggtctacgttacccggagttggtaggggaccgaaacggggccctacggtccaaccgttctccctcacgccctccaaccgaacgggcccctagttccggtcccttccccccgtcggcccacccccttcctaccaacgacgcctacccgttcgggtgggggaccaacggacgggcccggcccgtggggcctcggtcccgtggtaccgaaacggtacttacccgttccgttacggtcgtacgtcttacgtcgggacgggccggggtcgtacgggaccggaacggccggtacgaagttacggnnacgnnnnnnnnngnnnnnngnnnnnnnnnnnnnnnnnnnnnnnnnnnnnnnnn

SEQ ID NO: 280201 - DNA, 566 bp, Homo sapiens
  misc_feature: GYAE6OF01AU5SC.47.38.D05.1.454.CMB.1.raw
  modified_base (529)..(566): a, c, t, g, unknown or other
  misc_feature (529)..(566): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagtacggacgtattacgtacgtttttgatttcggtctaacgtttaccccgggacgttggtacgggggacaaaacgggggaccctaacgggttccaacccggtttcctccctcaacgtcccttaccaaccgaaacggggtcccccaagttccggtcctttacccccctggcccacccccttcctcccaaagtacggccaaccgtccgtggggggacaaccgacgccgggtaccctggggcctgcccgttgggttaccaagggtaccgttaaacctttcccgttaaacggttcggaaccgcgttcccgttagaccgggccgggtccgtcgggacaaacgggccgacagttaacggcagcnnnnnnnnnnnnnnnnnnnnnnnnnnnnnnnnnnnnnn

SEQ ID NO: 280202 - DNA, 478 bp, Homo sapiens
  misc_feature: GYAE6OF01A3BUX.47.38.D05.1.454.CMB.1.raw
  modified_base (431)..(478): a, c, t, g, unknown or other
  misc_feature (431)..(478): n is a, c, g, or t
tcagagctcacgtacacgaccggtgctcgatttagtatctgatagttgggtttgggtgcccaagctgctggaggcacggtcaccacgctgctgagcagtctgagacctgacgacacggccgtgtattattgtgcgttagttacggacattacgacgttttgattggtcattacccggagtgtggggacaaagggaccacggtcaccgtctcctcacgccctccaaccgaacgggcccctagtccggttcccttaccccccgtggccctacccctccctaccgaagacgccaccgttcggtcgggggacaccgacggcccggtacccgtgggctcgtccgtgggtaccaaacgggttcctaccgtttccgtacggttagacgtcctcgtggacggccgggtcgacggacaacgggccgactaagtacgcagnnnnnnnnnnnnnnnnnnnnnnnnnnnnnnnnnnnnnnnnnnnnnnnn

SEQ ID NO: 280203 - DNA, 764 bp, Homo sapiens
  misc_feature: GYAE6OF01CQFT9.47.38.D05.1.454.CMB.1.raw
  modified_base (661)..(661): a, c, t, g, unknown or other
  misc_feature (661)..(661): n is a, c, g, or t
tcagagctcacgtacacgaccggtgctcgatttagtatctgatagttgggtttgggggagcatcacccagcaaccacatctgtcctctagagaactcccctgagagtccttccgttcctcaccagtggactggaccgtggagactcctctttcgttggtggcacgcacgccaacgagggactacccacctcccgtaggttcgacctaacggttggtcgcgtaggtccggtgggcgtaggagggtagaaggacggccggtcggggtacctcgtaggtaggtacgttcctccgtgacgtaacggtcttacgtaggaactacgacgtccttaccaaccgtacttaacgttagttcgaccgtggtcggggtaccggccggtacccggtacccgtaggaacggtacgggttcgtaggtaggtgggtaggacgggacgtaacgtaccgaacgtacccgtaaaggtcgggagtaacaaaccgtaactaaacgttcgacgaacgttacgtagggtttaacggtacggaacgggtacggtacgggtaccaaccggtgtaaccggaaccggacgggtaacctacgtaacctacggtacgaacgtaccgaacgtaccgtagacggtacggtaacgtcgaggaacccgtaggtacgttacgaggtaacccggntaacccggagtaccggtacgtcgttagttatacggtgttagttacggtagggttaccgaagtttgttaccggttagtttagtaaccgtggttacgttaccggg

SEQ ID NO: 280204 - DNA, 743 bp, Homo sapiens
  misc_feature: GYAE6OF01CGL57.47.38.D05.1.454.CMB.1.raw
  modified_base (167)..(167): a, c, t, g, unknown or other
  misc_feature (167)..(167): n is a, c, g, or t
  modified_base (262)..(262): a, c, t, g, unknown or other
  misc_feature (262)..(262): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctcgtgggtctctggatccgaggtggggatattgtgatgactnagtcctccacttcctccctcgcccgtccacccgtggacgcggcccgcctccacttcctccgtagctaggttaccacgccaggactcctacttaanagttaagtaagtagtacttacaaactttagtttaggaactttcggtacctgacgaagacgtcgaggtactgttccaccgtatacgtcctcgtagttacgttcgtttggttttcggtctacggtacggtcccgggtcccggtcccgggtacctggtacgtacggttcggtacggtggacgtaggtcgtacgtacggacggtacctaagttcgtttaacgtttaccgtaacgtaaagtaaacgtacgggttagggtaacggggtggtacggtggtagggttaggttacggttttggggtttaacggtttagtacgttgtacgtagtaccgttaacgttaacgttaccttaaacgttaacccttttacggttaacccgtttcgggttaccgggaaccgggtaacgggtaaccgtacggtagggtagtaaacgaaccgttaaacgaacggttacgttagggccggtaacctcgtaaaccgtaccg

SEQ ID NO: 280205 - DNA, 723 bp, Homo sapiens
  misc_feature: GYAE6OF01A1TAJ.47.38.D05.1.454.CMB.1.raw
tcagagctcacgtacacgaccggtgctcgatttagtatctgatagttgggttggggtgatcaggactcctcagttcaccttctacacaatgaggctccctgctcagctccgtgggctgctaatgctcgtgggtctcgtggactccgagtgggattagttgtgatcgactctagtcctccactcgtccctcgcccgtccacccgtggacgacggcccggtcctaccgatcctaccgtgcgtacgtctacggaccaggtactccctacttaacgtagtaagttaagtcggtaacttacctaaatttagtttaagaacggtttaccggtacctcggtacgaaggaacgtaccggaggtacctacgtcctaccacgtaacgttccgtacgtcgtacgttcgtttagggtttcggtcgtacggtaccggtccgggtcccgttccgggtactagtaacgtggttacgacggtacggtactagggtacgactacggacgtaactacgttagttaacgttacgacgtaagtaaacgtacggtagggtagggtacggtacgggagtagggtagttcggttagggttttacgggttctaccgtgacttacgtaacgtacgttaacgtacctaacgttacctacgttacgttagggttccgacggtaaccgacgtcgcgtaacgacgtaacgtaaccgtaacggtacgtcgggtaagtccctacgtcctaacgg

SEQ ID NO: 280206 - DNA, 934 bp, Homo sapiens
  misc_feature: GYAE6OF01CNQRC.47.38.D05.1.454.CMB.1.raw
tcagagctcacgtacacgaccggtgctcgatttagtatctgatagttgggtttggggtgatcaggactccttcagttcaccttctcacaatgaggctccctgctcagctccgtgggctgctaatgctcgtgggtctcgtggacttccgaggtaggggtattagttggtagaattgactcgagttcctacctacctcctcccgtcgccccgttccaaccccggtggaacggccggcccggtaccctacccgtacttcccgtccgtagacgtacggttaccacggaccgaaagggcctcctttacgttaactaagttaaggttaacgtacggttaactttacctaaacgtttagttttacgtaaacgtttcggtaaccctggaacgaaggaccggaccggtacgggacctacggttccacccgaacgtccgtcctaacgtgttacgttcgtttaggttttacggtctacggtccggtcccgggttacccggttcccgggggtcccttagggtaaccggtttcgggttacgacgggtacggtacggtaaggttcggacgttccggaacggtccgtaacggttaacggttttaacggtttaaccgtaacgttaaaacgggtaaacgttcggggtaacggggttaaaggggtcggggaacggttagggttaggggttaacgggtttagggtttttaccgggggtttttaaaggtttacgttaccgtttacggtacgttaacgtacgggtttaaacccgttaacggtttaacccttaaaaccggttttacctttacccggtttaacgtttaccgggtttaacccgggaaccggttaacggggtaaaccgttaacggtcggttaaacgggaaacccgttaaaccgtaaacggtaaaccgtaaccgggtttggttaccgccgttaacgtaccccgttaaccg

SEQ ID NO: 280207 - DNA, 712 bp, Homo sapiens
  misc_feature: GYAE6OF01A2WAC.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctgggctgctaatgctctgggtctctggatccgagtggggatattgtgatgactcagtctccactctccctgcccgtcacccctggagcgaccggtcctccgatcctcctgcgaggtctacgcctagagtcctacttacatagtaatggtaattacaacgttatttgtaacttggtacctgctaaggaacgccgagggcctagtaccttccgacgtacgccttccgtagacttcgtgtttcgggtctggacgtcccggtccgttccggggtccctggacgtaggttcgacggttcggacctagggtacgactcggacggtacgtacgacgttactttacggacgttaacgaaaacgttcgaacgggtagggtaggtacgggacggttaggaacgggttagttacgggttttacgggtttaacgttacgtacggtacgtacgtacgtacgtaacggtttacctaaaccgttaaacccttacccgttaacgttaccggtttaacggacccggttaagggtaacccggtacggtacggttaacggaacgtaaccgttaaacggtaacggtaaacgttacggttacggaccgttacggacctaaacg

SEQ ID NO: 280208 - DNA, 840 bp, Homo sapiens
  misc_feature: GYAE6OF01AKC8M.47.38.D05.1.454.CMB.1.raw
  modified_base (813)..(813): a, c, t, g, unknown or other
  misc_feature (813)..(813): n is a, c, g, or t
  modified_base (819)..(819): a, c, t, g, unknown or other
  misc_feature (819)..(819): n is a, c, g, or t
  modified_base (821)..(821): a, c, t, g, unknown or other
  misc_feature (821)..(821): n is a, c, g, or t
  modified_base (823)..(823): a, c, t, g, unknown or other
  misc_feature (823)..(823): n is a, c, g, or t
  modified_base (827)..(837): a, c, t, g, unknown or other
  misc_feature (827)..(837): n is a, c, g, or t
  modified_base (839)..(840): a, c, t, g, unknown or other
  misc_feature (839)..(840): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacaggaggtttcgagggcgagggtcaccatcgaccgagggaccacgtccatcagtacagcctacagtggagtctgagcgtagtcgtgacgaccgtaggaccggacgaccgggtccggttaggttatttaacgtttggttaggtacggttttaacgggttaacgggacggttaacgtttaaccgggtttaccgtttttaggtacgtttgggttaccgtaaccgtttaaccccggggtacgggtttcggggtacgggggtaaccggaaaaccggggaacccggtaccgggttacccgtaacccggtttcccttcccctaccggtaccggtcccctaccccgaacccgaaaccggggacccctaaccggttccccggggttcccctttccccccggtccggtacccctaccccccgttcccgtacccgaaacggtaccgtcccgtaacccggttccgggtacgggggtccaaccggccgggtcccggtacccgggttcgggccggtttcccggtaccccggttcgggtaaccggtaaaccgggtttacccgtttaccccgtttaccccgtttaacgggttcggaaccggttcccgttacggtcggggcccggggtacccgggtaccggggtcgggaacccggtaaggggtcccggtaaccgtaggttaacgggcncgagcngngngcgnnnnnnnnnnngnn

SEQ ID NO: 280209 - DNA, 776 bp, Homo sapiens
  misc_feature: GYAE6OF01EXKPX.47.38.D05.1.454.CMB.1.raw
  modified_base (133)..(133): a, c, t, g, unknown or other
  misc_feature (133)..(133): n is a, c, g, or t
tcagagctcacgtacacgaccggtgctcgatttagtatctgatagttgggtttgggtgcccaagctgctggagggcacggtcaccacgctgctgagcagtctgagacctgacgaccacggtccgtgttaattnttgtgtacggtttaggttacgacgtatttacggtacgtttttgatttggtacctaacgtttaccccgggaggttggtacgggggacaaaacggggtaccctacgggtccaaccgttccgtcctacgcgtccctacccgaaccgtaacgggccctagttccggtcctttcccccgtggccctaccccgtctacgaagactccaccgtcggtcgggcacgacggccggacccgtgggctacgtccgtaggtaccgtaaacggtaccttaacctttccgacggtttacggaacgtcccgtcgttacgggtaccggtaccgggtccgttacgggaccgtaaacggggcctttacgaaacgggttacggccgtaattacgcccgtaattcgtacggacttacgtacgaccccgggttagaccgtagtacgtacgtaccgtacgtacgtacgtacgtacgtacgtacgtacgtacgtagtagtacgtacgttacgtacgtacgtacgtacgtacgtacgtacgtacgtacgtacgtacgtcgtacgtacgtacgtacgttacgtacgtcgtacgtacgtaccggtacgtaccgtacgacggtaccgtaccgtacgtaacgtacgtaccgtaaccggtacgtcgcgtacg

SEQ ID NO: 280210 - DNA, 758 bp, Homo sapiens
  misc_feature: GYAE6OF01ES7JP.47.38.D05.1.454.CMB.1.raw
  modified_base (243)..(243): a, c, t, g, unknown or other
  misc_feature (243)..(243): n is a, c, g, or t
tcagagctcacgtacacgaccggtgctcgatttagtatctgatagttgggtttgggggaggactcctcagttcaccttctcacaatgaggctccctgctcagctcctggggctgctaatgctcgtgggtctctggatccgaggtggggatattgtcgatgactcagtctccactctccctcgcccgtcacccgtggagacgtcccggcctccatcctcctgacgtaggtcctaggccaggacncctacttaacatagtaagtggtattacaacttatttagaattcggtacctgacaagaacgccgagggtcctagtcctaccgtaacgacgtcttacctggacttcgtttggtttacgggtttcgtacggtacgtccggggtcccgttcccgggggtccctaggtaacgtaggtttccgaagggtcggacgtaggtaggtactcgaacggacctaacgtaagggtttaacttttaccgacgttaaacggtaaaagtcggtaaggggttaagggggtaggtacgggtacgttagggtaagggttaggtttacggggttttaacgggttttaagtttaccgtaggtaccgtaagttacggtaaccgttaaaggttaccctaaaccgttaaaccctttacccgttaacgttacggtttacggaccggtaacggggtaacctaaggtacgtagggaacgtacgtaaacccgtaaacggtaccgttaggtacgtacgtacgtaccacctaagttcttaccgg

SEQ ID NO: 280211 - DNA, 791 bp, Homo sapiens
  misc_feature: GYAE6OF01BTG7H.47.38.D05.1.454.CMB.1.raw
  modified_base (211)..(211): a, c, t, g, unknown or other
  misc_feature (211)..(211): n is a, c, g, or t
tcagagctcacgtacacgaccggtgctcgatttagtatctgatagttgggtttgggggagcatcacccagcaaccacatctgtcctctagagaactcccctgagagctccgttcctcaccatggactcggacctggaggatcctcttcttggtggcagcacgccacaggacgtccacctccagttcgcactggtcgcagtcgtgggctggnggtagaacgagccgtcgggcctacgagtgaacgtctcgtacgcgagtcgttctaggactactacgtccttaccgacccgttaacttattacgtttcgcgtacgttgggcggccgggacccgggtcccctagggaaccgtaaggtccggttagggaggttcgggaggttacggggtaacggtacgtaccgaaccgtaccccggttaaagtcggggttacgggttacggaacccgtaaacgtaaaccgttgtaacgaaccgtacggtaggttacggttcggagggtacgtacgggtaccacgtacgtccgaacgacgggtacctaccgtacctagtacctaacggacctaggtaccctaaagcggttacggaaccgtgtaacggtaccgcggtaacgttgaaccggtaccgtaccggacgaaccgtaccggtacccgggttagttaaccgttgtttacggtttagggtaccggttaaccgggtttcggttaaacccgggtaacccttttaacgggttttaaccggggtttaccgttttagggtttaacgtttaccgggggtttaacctttaaccccgggggg

SEQ ID NO: 280212 - DNA, 693 bp, Homo sapiens
  misc_feature: GYAE6OF01DP3Y2.47.38.D05.1.454.CMB.1.raw
  modified_base (121)..(121): a, c, t, g, unknown or other
  misc_feature (121)..(121): n is a, c, g, or t
  modified_base (612)..(612): a, c, t, g, unknown or other
  misc_feature (612)..(612): n is a, c, g, or t
  modified_base (650)..(650): a, c, t, g, unknown or other
  misc_feature (650)..(650): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (677)..(678): a, c, t, g, unknown or other
  misc_feature (677)..(678): n is a, c, g, or t
  modified_base (681)..(683): a, c, t, g, unknown or other
  misc_feature (681)..(683): n is a, c, g, or t
  modified_base (685)..(685): a, c, t, g, unknown or other
  misc_feature (685)..(685): n is a, c, g, or t
  modified_base (688)..(688): a, c, t, g, unknown or other
  misc_feature (688)..(688): n is a, c, g, or t
  modified_base (690)..(693): a, c, t, g, unknown or other
  misc_feature (690)..(693): n is a, c, g, or t
tcagagctcacgtacacgaccggtgctcgatttagtatctgatagttgggtttgggtgcccaagctgctggagggcacggtcaccacgctgcttgagtggatgggacggatcagccctaanagtggtgcacaaactatgacacagtaggtttcgaggcaggtcacatgaccaggcacgtccatcagtacacgtacctacacgttggagcgtagacgcagtacgtgaacggtacctgaaccgaaccgacggtccgtagttattagttggtcggtacgtttaggttaccggaacgttagttaccgttacggttttgacgtttggtaccttaacgttacccgggtagttgggtacggggtaacgaaaccgggtaccgaccggtactacccgttacttcccgttaccgacgtccctaccgaaccgaccggtacctacgttccggttaccccttcccccgttaggaccccttaaccccgtccgtaaccgaacgtaccgtacaccccggttcggcggggacctaacggccgtcccgggtccgtacggggtctaccggtccgtacgtaaccgtaaggtaccctttaaccgttccgacgtacggtccgtacgtttaccgngggaaccgggccgggttagaccggtacggaacccggtnttaccgggattaacggctgctngngcnntcnnncncanannnn

SEQ ID NO: 280213 - DNA, 561 bp, Homo sapiens
  misc_feature: GYAE6OF01EAUBP.47.38.D05.1.454.CMB.1.raw
  modified_base (143)..(143): a, c, t, g, unknown or other
  misc_feature (143)..(143): n is a, c, g, or t
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (536)..(536): a, c, t, g, unknown or other
  misc_feature (536)..(536): n is a, c, g, or t
  modified_base (540)..(541): a, c, t, g, unknown or other
  misc_feature (540)..(541): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (548)..(561): a, c, t, g, unknown or other
  misc_feature (548)..(561): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtcgcacaaactatgcanagaggtttcagggcagggtcacatgaccaggacacgtcatcagtacagcctacatggagctgagcagtctgagacctgacgacgacggccgtagttattagttggtgtcgtttaggttacggacgtagttacgtacgttttgatttggtctagtttacccgggagttggtacgggactaaaggggcccacggtcaccggtctcctcncgtccctccaaccgaggcccagtccggtccttcccccgtggaccncccctccgtacaagacncctacncggtgggccacgnggccgccgtgggctcggacccgtagacgtacggacttaccgttccgtagtcgactcgtcgtaggacggtccggtcgtacggacgaagggtccgtaacgagtaggntcgnngngnngnnnnnnnnnnnnnn

SEQ ID NO: 280214 - DNA, 455 bp, Homo sapiens
  misc_feature: GYAE6OF01B52KW.47.38.D05.1.454.CMB.1.raw
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (437)..(439): a, c, t, g, unknown or other
  misc_feature (437)..(439): n is a, c, g, or t
  modified_base (441)..(455): a, c, t, g, unknown or other
  misc_feature (441)..(455): n is a, c, g, or t
tcagagctcacgtacacgaccggtgctcgatttagtatctgataggttggggtttgggtgcccaagctgctgggagggcagggtcaccatgaccagggacacgtccatcagtacacgcctacagtggagctggagcagtctagacgacctgaaccgaccgccggtcgtagttatttagttggtgtcggttaaggtacggacgttagttacgttagtttagtagttggtacctacggttaccgggaggtgggtacggggaacgaaacgggaccacggtaccaccgtcctaccgacgccctaccgacgtacggcctacgtccgtcctcccgtgccacctcacagtcnctacgcggnggcacgngccgtcgnggctcgcgtagacacgtacttcctcgagtcgatcgtcngggacgtgggacgnggacggagcgatangnnngnnnnnnnnnnnnnnn

SEQ ID NO: 280215 - DNA, 899 bp, Homo sapiens
  misc_feature: GYAE6OF01BUNIE.47.38.D05.1.454.CMB.1.raw
  modified_base (168)..(168): a, c, t, g, unknown or other
  misc_feature (168)..(168): n is a, c, g, or t
tcagagctcacgtacacgaccggtgctcgatttagtatctgatagttggggtttggggtgatcaggactcctcagttcaccttctcacaatgaggctccctgctcagctccgtggggctgctaatcgctcgtgggtctcgtggactccgagggtggggtattagttgngatgactcacgtcctccactcctcccgtccgcccgtccacccgtggacgcgcccgcctcacttcctcctgacgtacgtcgtacgcgacgtccgtccttactaacgtaagttaagttaagtacgtactttaactaaacgtttagtttacgtaaacggtttcggtaccgtggaaccgaaaggaaccgccggagggtcctaacgtaccctacccgaacgtcgttaccctccggttagaccttttacgggtttggttttcgggtacccgtgggtacccggggttccccggggttccccgggttacccggggttaccctagggttaaccggttccgggttagtacggggtccggtacgtacgggtacggttacgaccggtaacgggtaccttaacggttaacggttttaacggtttaaccggtaccgttaaaacggtaaacggttcgggtaagggggttacgggggtagggtacgggtaccggttaaggggttagggtttaaggttttacgggggttttacgggttttaaacttcggtaggtcgtaaggttaccggttaaccgttaacgtttaacccgttaaacgttaaccccgtttaccttaaccggttaccgggttaccgggtaaccggtaaaccggggttaccctaggttaccggtaaagggtaccgaaaccgttaaaccggaaaccggttacgggttacggtaaccggtaccgtacccgtcgtttaaaccgg

SEQ ID NO: 280216 - DNA, 813 bp, Homo sapiens
  misc_feature: GYAE6OF01DCU98.47.38.D05.1.454.CMB.1.raw
tcagagctcacgtacacgaccggtgctcgatttagtatctgatagttgggtttggggaggactcctcagttcaccttctcacaatgaggcctcccctgctcagccgtccgtggggctgctaatgctcgtgggtctcgtggactccgaggtgggattagttgtgatgactcgacgtcctccacctcctccctcgccccgtccacccgtggacgacgcccggccctccacttccctccgtgccgtacggttacctacgccgaacggtaccgtcccttacgttaacaagttaaggttaacgtaggttaacttacctaaacgttttagtttagttaacgtttacggtacctagacgaacggaacgaccggacggactaccgtacctaccgacgacgtcccgtaccgttaggttcgtttcggtttggttttcgggtacgtcggtaccgggttcccgggttcccggtacccgggttccgtagtaccggttacggtcgtacgggtggtaccgtaggtacgacgtaccggacgtacgtaacgttagtttaaccgtttacggaacgtaaaggtaacggtagggtaagggggtgggtaggaggtagtagggtaggtttagggtttaggggttttagtttacgttcgtagtcgttagttaacgtccttaaaccttaaccttaacccgttacctttaccgttaccgtttacgggttaccggaaccggtaaccgggtaactggggtacgtaacggaacgttaaaccgtaacggtaaacggttaggtcccggtgtaccctacggacccttactccggtttccgtacg

SEQ ID NO: 280217 - DNA, 263 bp, Homo sapiens
  misc_feature: GYAE6OF01A38NN.47.38.D05.1.454.CMB.1.raw
  modified_base (106)..(106): a, c, t, g, unknown or other
  misc_feature (106)..(106): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (183)..(185): a, c, t, g, unknown or other
  misc_feature (183)..(185): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (193)..(263): a, c, t, g, unknown or other
  misc_feature (193)..(263): n is a, c, g, or t
tcagagctcacgtacacgaccggtgctcgattttagtatctgatagttgggtttggggggaagaggaaggactgacggtccccccaggagttcaggtgctgggcanagccggccctgggctgcctggtcaaggactacttccaacgtgagctctgagcgggctggccaaggcncatagntnannntnancnannnnnnnnnnnnnnnnnnnnnnnnnnnnnnnnnnnnnnnnnnnnnnnnnnnnnnnnnnnnnnnnnnnnnnn

SEQ ID NO: 280218 - DNA, 441 bp, Homo sapiens
  misc_feature: GYAE6OF01BA2EL.47.38.D05.1.454.CMB.1.raw
  modified_base (281)..(281): a, c, t, g, unknown or other
  misc_feature (281)..(281): n is a, c, g, or t
  modified_base (389)..(390): a, c, t, g, unknown or other
  misc_feature (389)..(390): n is a, c, g, or t
  modified_base (392)..(393): a, c, t, g, unknown or other
  misc_feature (392)..(393): n is a, c, g, or t
  modified_base (395)..(396): a, c, t, g, unknown or other
  misc_feature (395)..(396): n is a, c, g, or t
  modified_base (398)..(401): a, c, t, g, unknown or other
  misc_feature (398)..(401): n is a, c, g, or t
  modified_base (403)..(441): a, c, t, g, unknown or other
  misc_feature (403)..(441): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagaccctgacgacacggccgtgtattatgtgcgttagttacggacgattacgacgtttttgattggcattacccggagtgtggggcaaaggggccaggtcaccgtctcctcagcctcaccaagggccccatccggtcttcccccnggccacccctcctccaagacgcaccctctgggggcacagcggcctgggctgcctggtcaggactacttcctacgtgagctctgacgcgggctggcaaggcgcataggnngnncnngnnnngnnnnnnnnnnnnnnnnnnnnnnnnnnnnnnnnnnnnnnn

SEQ ID NO: 280219 - DNA, 819 bp, Homo sapiens
  misc_feature: GYAE6OF01CX428.47.38.D05.1.454.CMB.1.raw
  modified_base (156)..(156): a, c, t, g, unknown or other
  misc_feature (156)..(156): n is a, c, g, or t
  modified_base (304)..(304): a, c, t, g, unknown or other
  misc_feature (304)..(304): n is a, c, g, or t
tcagagctcacgtacacgaccggtgctcgatttagtatctgatagttgggtttggggaggactcctcagttcaccttctcacaatgaggctccctgctcagctccgtggggctgctaagtgctcgtggtctctggactccgaggtggggatattgngatcgactcacgtcctccactcctccgcgcccgtccacccgtggagcgccgtcctctactcctcctgactacgtctacgccgagctccttacttacgaagttagtagtacgtactttactaacgtttattacggtagttaccgttacngacgacgaacgcggtagacgtcgttcccaccgctaccgtcctccgtagttacgtttcggtttgggtttacggtacgtgggtaccgggttcccggtccccggttaccgggttcgtaccggtaacggttacggttcgggttaaggcggtacggtacggtttaggaccgtacggaggtacccgtaggtttaactttaacgtttacggtaacgttaacggtaaacggttacggttaaggggtaagggtacgggtacggtaacggttagggttacgggttagggtttttacgggttttaggtttaagtttaccgtacggtaacgttacggttacgtaaccgttaaactttaaccgttaacccgtttaacccttttaccgttaaccggtttaccggttttaccgggaacggggtaccggtaacggttaccggtacggtaaacggttaacgtaaacggttaaacggtggttacggtaccggtccgttacgtacgttaccgttcgttccgttcgtttaccccg

SEQ ID NO: 280220 - DNA, 480 bp, Homo sapiens
  misc_feature: GYAE6OF01EGQTI.47.38.D05.1.454.CMB.1.raw
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
  modified_base (444)..(444): a, c, t, g, unknown or other
  misc_feature (444)..(444): n is a, c, g, or t
  modified_base (451)..(480): a, c, t, g, unknown or other
  misc_feature (451)..(480): n is a, c, g, or t
tcagagctcacgtacacgaccggtgctcgatttagtatctgatagttgggtttgggtgcccaagctgctggagggcagggtcaccatgaaccagggacacgtccatcagtacagccctacatggagctgagcagtctgagacctgacgacacggctgtattattgtgcgttagttacggacgattacgtacgttttgattggtcacgttaccccggngtggtggggacaaagggccacggtcacccgtctcctcacgccctccaaccgaacgggtcccagttccggtcccttcccccgtggccctaccccgtcctaccgaagacncctaccgtcgtcgggggctacgcggccggcccgtggctcgccgtcggtacgaacggtaccttaccttccgtacgtagacgtctcgtaggacgggacgggcgtgggaccgaaggccgtanagtacgnnnnnnnnnnnnnnnnnnnnnnnnnnnnnn

SEQ ID NO: 280221 - DNA, 782 bp, Homo sapiens
  misc_feature: GYAE6OF01BZC8V.47.38.D05.1.454.CMB.1.raw
tcagagctcacgtacacgaccggtgctcgatttagtatctgatagttgggtttgggggagcatcacccagcaaccacatctgtcctctagagaatccctgagagctccgttcctcaccatggactcggacctgggaggactcctctttcgttggtggcagtcgacgccacaggcgtccacctcccgtagttgactaacgtggtcgctaggtcgtgggctggaggtgaagacgcgtcgggctcgagtcgtagtctcgtagacagtccttgaggactacgacgtaccttccgaccgtaacttacttacgtttcgacgtacggtcgggtacggtaccggaaccggggttcccaagggtaacccggtaaggggttccgtttagggaagggttcgggaaggtacggggaacggttagttaccggaacggttacccgtaaacggtacgggttacgggtacgaacctaaacgtaaaccgtgtaaccggacgtaaccggagggttcggtttaccggagggtaccggtaggttaccaacgtacgaacgggtaccgacggtaacgtaccgtaccgtaacgtacggtaacgtacgtaccgtaccgtaacgtaacggtacgggaacgtcgacggcgaacgtgtaccgttaccgaacggttacccgtacggaccggtaaccgggtacgggtacgtttggttaaacgtttcgttaacggttcggttaaccggttacggttacggttaacgttacggtttacgttacggtttagtacggttcgttaccggtaacggg

SEQ ID NO: 280222 - DNA, 933 bp, Homo sapiens
  misc_feature: GYAE6OF01A3P3K.47.38.D05.1.454.CMB.1.raw
tcagagctcacgtacacgaccggtgctcgatttagtatctgatagttgggtttgggtgcccaagctgctggagggcacggtcaccacgctgcttgagtggatgggacgatcagccctaacaggtggtcggcaacaaacgtatagcaagagtaggttcagggcaggtcacatgaccaggtacacgtcatcgagtacacgctacagtcggagctgaacgcgtaagtctagaacgtaccgtacggacgtaaccgacgggtccgttagttaagtttagtttacgtacggttacggtttaacgggttaaccggtaacggttaacgtttaaccggttaacggtttttaggtacgttttacgggtaccgtaaccgtttaacccggggtaccgtttagggggttacgggggaaaccgtaaaacggggacccgtaaccgggtacctaacccgggttccttacccgtacgaaccgtaccccgttaaccccgaaccggtaaaccgggtcccctaaacggttccccgggtttaacccgtttcccccgaccgggtaccctaaaccccccttaccgttaaccgaaacggtaccgtcccgttaaccccggtacggggttacgggggaccccttaaccgggaccggggttaccccggttaccccgggtacgggtacgttacccgggtacccggtttaacgggtaacccggtaaaaaccgggttaccccgttttaacccgtttacccgggtttacgggtaaccgggtacgttaaccccgggtttgtaaaccgggggttaccgggcccggggtaacgtttccccggggaaaccggtaaacccggggtacccgggttatttaaacccgggaaggcttaaaccgccgttagtaacgtacgccgggttaatacgtacgtacgacgtacgacgtacgtacgagacgtacgagacg

SEQ ID NO: 280223 - DNA, 397 bp, Homo sapiens
  misc_feature: GYAE6OF01EMVLH.47.38.D05.1.454.CMB.1.raw
  modified_base (294)..(294): a, c, t, g, unknown or other
  misc_feature (294)..(294): n is a, c, g, or t
  modified_base (374)..(397): a, c, t, g, unknown or other
  misc_feature (374)..(397): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgtttagttacggacgattacgacgttttgattggtcattacccggagtgtggggcaaagggccacggtcaccgtctcctcagccctccaccgaagggcccagttccggtccttccccctggccaccccctcctccaagcgccaccgtcgtggggcacgngccggcccgtgggctgccgtggcaaggacttaccttcctacgtgacgctcgtggacgcgggctggacgaaggcgcatagnnnnnnnnnnnnnnnnnnnnnnnn

SEQ ID NO: 280224 - DNA, 170 bp, Homo sapiens
  misc_feature: GYAE6OF02IVDTB.47.38.D05.1.454.CMB.1.raw
  modified_base (170)..(170): a, c, t, g, unknown or other
  misc_feature (170)..(170): n is a, c, g, or t
tcagagctcacgtacacgaccggtgctcgatttagtatctgatagttgggttggggaagaggaagactgacggtccccaggagttcaggtgctgggcacagcggccctgggctgcctggtcaaggactacttcctacgtgagctctgagcgggctggcaaggcgcatagn

SEQ ID NO: 280225 - DNA, 352 bp, Homo sapiens
  misc_feature: GYAE6OF02G0FDT.47.38.D05.1.454.CMB.1.raw
  modified_base (350)..(352): a, c, t, g, unknown or other
  misc_feature (350)..(352): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactatcctacgtgagctctgagcgggctggcaaggcgcatagnnn

SEQ ID NO: 280226 - DNA, 172 bp, Homo sapiens
  misc_feature: GYAE6OF02IUZPN.47.38.D05.1.454.CMB.1.raw
  modified_base (172)..(172): a, c, t, g, unknown or other
  misc_feature (172)..(172): n is a, c, g, or t
tcagagctcacgtacacgaccggtgctcgatttagtatctgatagttgggtttggggaagaggaagactgacggtcccccaggagttcaggtgctgggcacagcggccctgggctgcctgatcaaggactacttcctacgtgagctctgagcgggctggcaaggcgcatagn

SEQ ID NO: 280227 - DNA, 386 bp, Homo sapiens
  misc_feature: GYAE6OF02I13KQ.47.38.D05.1.454.CMB.1.raw
  modified_base (383)..(386): a, c, t, g, unknown or other
  misc_feature (383)..(386): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggaccacggtcaccgtctcctcagcctccaccaagggcccatcggtcttccccctggcacccctcctccaagagcacctctggggcacagcggccctgggctgcctggtcaggactacttcctacgtgagctctgagcggctggcaaggcgcatagnnnn

SEQ ID NO: 280228 - DNA, 220 bp, Homo sapiens; identical to SEQ ID NO: 280058
  misc_feature: GYAE6OF02H9OL4.47.38.D05.1.454.CMB.1.raw
  modified_base (219)..(220): a, c, t, g, unknown or other
  misc_feature (219)..(220): n is a, c, g, or t

SEQ ID NO: 280229 - DNA, 173 bp, Homo sapiens; identical to SEQ ID NO: 279918
  misc_feature: GYAE6OF02GDTS5.47.38.D05.1.454.CMB.1.raw
  modified_base (173)..(173): a, c, t, g, unknown or other
  misc_feature (173)..(173): n is a, c, g, or t

SEQ ID NO: 280230 - DNA, 390 bp, Homo sapiens
  misc_feature: GYAE6OF02HB4ES.47.38.D05.1.454.CMB.1.raw
  modified_base (380)..(380): a, c, t, g, unknown or other
  misc_feature (380)..(380): n is a, c, g, or t
  modified_base (386)..(390): a, c, t, g, unknown or other
  misc_feature (386)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcncatagnnnnn

SEQ ID NO: 280231 - DNA, 531 bp, Homo sapiens
  misc_feature: GYAE6OF02GUJMH.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatcttgtttgggtctgagtcgggcctccggggtcctgacaggttcagtggctagtggatcgaggcacagtattttacgctagaaaatcgaaggtagggtggaggcgtggagggtattgggtttaggggtttattacgtgacatgacaagactaaactaaacttcctttacaccgttcgaccgaaggacacgactggactagttagacgtaacgtgtggctgactacc

SEQ ID NO: 280232 - DNA, 365 bp, Homo sapiens
  misc_feature: GYAE6OF02IYTV8.47.38.D05.1.454.CMB.1.raw
  modified_base (357)..(365): a, c, t, g, unknown or other
  misc_feature (357)..(365): n is a, c, g, or t
tcagagctcacgtacacgaccggtgctcgatttagtatctgatagttgggtttgggttggtcccgaacgctgctggagggcgacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccattcggtcttccccctggcaccctcctccaaagagcacctctggggcacagcggcctgggctgctggtcaaggactactcctatgtatactctgagcgggctggcaaggcgcatagnnnnnnnnn

SEQ ID NO: 280233 - DNA, 389 bp, Homo sapiens
  misc_feature: GYAE6OF02H7HL4.47.38.D05.1.454.CMB.1.raw
  modified_base (384)..(389): a, c, t, g, unknown or other
  misc_feature (384)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnnnnn

SEQ ID NO: 280234 - DNA, 477 bp, Homo sapiens
  misc_feature: GYAE6OF02HO6J8.47.38.D05.1.454.CMB.1.raw
  modified_base (466)..(477): a, c, t, g, unknown or other
  misc_feature (466)..(477): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnnnnnnnnnnn

SEQ ID NO: 280235 - DNA, 479 bp, Homo sapiens
  misc_feature: GYAE6OF02H1KLA.47.38.D05.1.454.CMB.1.raw
  modified_base (471)..(479): a, c, t, g, unknown or other
  misc_feature (471)..(479): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaacgagcacctctgggggcacagcggccctgggctgcctggtcaaggactacttcctacgtgagctctgacgcgggctgggcaaggcgcatagnnnnnnnnn

SEQ ID NO: 280236 - DNA, 172 bp, Homo sapiens
  misc_feature: GYAE6OF02JEHG7.47.38.D05.1.454.CMB.1.raw
  modified_base (171)..(172): a, c, t, g, unknown or other
  misc_feature (171)..(172): n is a, c, g, or t
tcagagctcacgtacacgaccggtgctcgatttagtatctgatagttgggtttggggaagaggaagactgacggtccccaggagttcaggtgctgggcacagcggccctgggctgcctggtcaaggactacttcctacgtgagctctgagcgggctggcaaggcgcatagnn

SEQ ID NO: 280237 - DNA, 363 bp, Homo sapiens
  misc_feature: GYAE6OF02GLFZ9.47.38.D05.1.454.CMB.1.raw
  modified_base (360)..(363): a, c, t, g, unknown or other
  misc_feature (360)..(363): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnn

SEQ ID NO: 280238 - DNA, 476 bp, Homo sapiens
  misc_feature: GYAE6OF02GJNXM.47.38.D05.1.454.CMB.1.raw
  modified_base (467)..(476): a, c, t, g, unknown or other
  misc_feature (467)..(476): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaagggcgcatagnnnnnnnnnn

SEQ ID NO: 280239 - DNA, 539 bp, Homo sapiens
  misc_feature: GYAE6OF02HETP7.47.38.D05.1.454.CMB.1.raw
  modified_base (323)..(323): a, c, t, g, unknown or other
  misc_feature (323)..(323): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcctgcagactaatggaaatacctatttggattggtacctgacaaaagccagggcagtctccacaactcctgatctatttggcttttaancgggcctccggggtccctgacaggttcactggcagtgatcaggcacagtattttacattagaaaatcagcagagtggagctgacgatgctggtatttattactgacatgacaagtctaaaacaaacttcctttacacccgtttcggacctaacggggactaaccggactagggaacctaagtttacggaacgtaaccgttggtacggcttacgacc

SEQ ID NO: 280240 - DNA, 173 bp, Homo sapiens; identical to SEQ ID NO: 279918
  misc_feature: GYAE6OF02IG5Z4.47.38.D05.1.454.CMB.1.raw
  modified_base (173)..(173): a, c, t, g, unknown or other
  misc_feature (173)..(173): n is a, c, g, or t

SEQ ID NO: 280241 - DNA, 406 bp, Homo sapiens
  misc_feature: GYAE6OF02IZKK2.47.38.D05.1.454.CMB.1.raw
  modified_base (274)..(274): a, c, t, g, unknown or other
  misc_feature (274)..(274): n is a, c, g, or t
  modified_base (387)..(406): a, c, t, g, unknown or other
  misc_feature (387)..(406): n is a, c, g, or t
tcagagctcacgtacacgaccggtgctcgatttagtatctgatagttgggtttgggtgcccgaagctgctggagggcagggtcaccatgaccagggacacgtccatcagtacagcctacatggagctgagcagtctgagacctgacgacacggccgtgtattattgtgcgttagtacggacgattacgacgttttgattggtcattacccggacgtgtggggcaaagggccacggtcaccgtctccgtcagcctccaccaagggcccatcggtnttccccctggcacccctcctccaagagccacctctgggggcacagcggccctgggctgcctggtcaaggcctactcctacgtgagctctgagcggcgtggcaaggcgcatagnnnnnnnnnnnnnnnnnnnn

SEQ ID NO: 280242 - DNA, 391 bp, Homo sapiens
  misc_feature: GYAE6OF02F7NV4.47.38.D05.1.454.CMB.1.raw
  modified_base (387)..(391): a, c, t, g, unknown or other
  misc_feature (387)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcacccctcctccaagagcacctctgggggcacagcggccctgggctgcctggtcaaggactacttcctacgtgagctctgagcgggctggcaaggcgcatagnnnnn

SEQ ID NO: 280243 - DNA, 356 bp, Homo sapiens
  misc_feature: GYAE6OF02IZQEB.47.38.D05.1.454.CMB.1.raw
  modified_base (352)..(356): a, c, t, g, unknown or other
  misc_feature (352)..(356): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggtcacagcggccctgggctgcctggtcaaggctacttcctatgtatactctgagcgggctggcaaggcgcatagnnnnn

SEQ ID NO: 280244 - DNA, 476 bp, Homo sapiens
  misc_feature: GYAE6OF02GC7J1.47.38.D05.1.454.CMB.1.raw
  modified_base (468)..(476): a, c, t, g, unknown or other
  misc_feature (468)..(476): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaagggctacttcctacgtgagctctgagcgggctgggcaaggcgcatacgnnnnnnnnn

SEQ ID NO: 280245 - DNA, 388 bp, Homo sapiens
  misc_feature: GYAE6OF02FYJJ1.47.38.D05.1.454.CMB.1.raw
  modified_base (385)..(388): a, c, t, g, unknown or other
  misc_feature (385)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnnn

SEQ ID NO: 280246 - DNA, 355 bp, Homo sapiens
  misc_feature: GYAE6OF02GQL27.47.38.D05.1.454.CMB.1.raw
  modified_base (352)..(355): a, c, t, g, unknown or other
  misc_feature (352)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggcctgggctgcctggtcaaggactacttcctacgtgagctctgagcgggctggcaaggcgcatagnnnn

SEQ ID NO: 280247 - DNA, 357 bp, Homo sapiens
  misc_feature: GYAE6OF02GWSBY.47.38.D05.1.454.CMB.1.raw
  modified_base (353)..(357): a, c, t, g, unknown or other
  misc_feature (353)..(357): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 280248 - DNA, 390 bp, Homo sapiens
  misc_feature: GYAE6OF02FRESL.47.38.D05.1.454.CMB.1.raw
  modified_base (385)..(390): a, c, t, g, unknown or other
  misc_feature (385)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnn

SEQ ID NO: 280249 - DNA, 511 bp, Homo sapiens
  misc_feature: GYAE6OF02IQFJR.47.38.D05.1.454.CMB.1.raw
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagcctaacagtggtggcacaaactatgcacagaggtttcagggcagggtcacgatgaccagggacacgtcatcagtacacgcctacatggagctagagacagtctgacgacctgacgacgacggccgtgtattagttgtgtcgttagttacggagtattacggtagtttgattggtctacgg

SEQ ID NO: 280250 - DNA, 394 bp, Homo sapiens
  misc_feature: GYAE6OF02I90YO.47.38.D05.1.454.CMB.1.raw
  modified_base (392)..(394): a, c, t, g, unknown or other
  misc_feature (392)..(394): n is a, c, g, or t
tcagagctcacgtacacgaccggtgctcgatttagtatctgatagttgggtttgggtgcccaagctgctggaagggcagggtcaccatgaccagggacacgtccatcagtaccagcctacatggagctgagcagtctgagacctgacgacacggccgtgtattattgtgcgttagttacggacgattacgacgtttttgattggtcattacccggacgtgtggggcaaagggaccacggtcaccgtctcctcagcctccaccaagggcccatcggtcttccccctggcacccctcctccaagagcacctctgggggcacagcggccctggggctgcctggtcaaggactacttcctatcgtatactctgagcgggctggcaaggcgcatagnnn

SEQ ID NO: 280251 - DNA, 475 bp, Homo sapiens
  misc_feature: GYAE6OF02HFQY9.47.38.D05.1.454.CMB.1.raw
  modified_base (467)..(475): a, c, t, g, unknown or other
  misc_feature (467)..(475): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctgggcaaggcgcatagnnnnnnnnn

SEQ ID NO: 280252 - DNA, 357 bp, Homo sapiens; identical to SEQ ID NO: 280247
  misc_feature: GYAE6OF02I1NR1.47.38.D05.1.454.CMB.1.raw
  modified_base (353)..(357): a, c, t, g, unknown or other
  misc_feature (353)..(357): n is a, c, g, or t

SEQ ID NO: 280253 - DNA, 388 bp, Homo sapiens; identical to SEQ ID NO: 280245
  misc_feature: GYAE6OF02HBF3O.47.38.D05.1.454.CMB.1.raw
  modified_base (385)..(388): a, c, t, g, unknown or other
  misc_feature (385)..(388): n is a, c, g, or t

SEQ ID NO: 280254 - DNA, 526 bp, Homo sapiens
  misc_feature: GYAE6OF02HSY85.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggtctgatcggcctccggggtcctgacaggttcagtggcagtggatcgaggcacagtattttacgctagaaaatcgagtagggtggaggctggaggagttggtttaggggtttattacgtgctagtgactaagttactaactaaacttcctaacgtactttggccgtagggaccgaagtcgtggaagatacgaacgacgtgtaggctgctaccg

SEQ ID NO: 280255 - DNA, 483 bp, Homo sapiens
  misc_feature: GYAE6OF02H1V6X.47.38.D05.1.454.CMB.1.raw
  modified_base (471)..(483): a, c, t, g, unknown or other
  misc_feature (471)..(483): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggggcaaagggccacggtcaccgtctcctcagcctccaccaaggcccatcggtcttccccctggcaccctcctccaagacgcacctctgggggccacagccggccctgggctgcctggtcaaggactacttcctacgtgagctctgacgcgggctggcaagggcgcatagnnnnnnnnnnnnn

SEQ ID NO: 280256 - DNA, 388 bp, Homo sapiens
  misc_feature: GYAE6OF02JBSVN.47.38.D05.1.454.CMB.1.raw
  modified_base (383)..(388): a, c, t, g, unknown or other
  misc_feature (383)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaggcgcatagnnnnnn

SEQ ID NO: 280257 - DNA, 389 bp, Homo sapiens
  misc_feature: GYAE6OF02GSSOL.47.38.D05.1.454.CMB.1.raw
  modified_base (385)..(389): a, c, t, g, unknown or other
  misc_feature (385)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnnnn

SEQ ID NO: 280258 - DNA, 358 bp, Homo sapiens
  misc_feature: GYAE6OF02GYEXP.47.38.D05.1.454.CMB.1.raw
  modified_base (353)..(358): a, c, t, g, unknown or other
  misc_feature (353)..(358): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnn

SEQ ID NO: 280259 - DNA, 353 bp, Homo sapiens
  misc_feature: GYAE6OF02HANFK.47.38.D05.1.454.CMB.1.raw
  modified_base (353)..(353): a, c, t, g, unknown or other
  misc_feature (353)..(353): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggcttcctggtcaaggactacttcctacgtgagctctgagcgggctggcaaggcgcatagn

SEQ ID NO: 280260 - DNA, 369 bp, Homo sapiens
  misc_feature: GYAE6OF02JBG3H.47.38.D05.1.454.CMB.1.raw
  modified_base (362)..(369): a, c, t, g, unknown or other
  misc_feature (362)..(369): n is a, c, g, or t
tcagagctcacgtacacgaccggtgctcgatttagtatctgatagttgggtttgggttggtcccgaacgctgctggagggcgacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctggggcacagcggcctgggctgccctaggtcaaggactacttcctacgtgacgctctgacgcgggctggcaaggcgcatagnnnnnnnn

SEQ ID NO: 280261 - DNA, 391 bp, Homo sapiens; identical to SEQ ID NO: 279925
  misc_feature: GYAE6OF02G04SO.47.38.D05.1.454.CMB.1.raw
  modified_base (386)..(391): a, c, t, g, unknown or other
  misc_feature (386)..(391): n is a, c, g, or t

SEQ ID NO: 280262 - DNA, 391 bp, Homo sapiens
  misc_feature: GYAE6OF02IBRAP.47.38.D05.1.454.CMB.1.raw
  modified_base (387)..(391): a, c, t, g, unknown or other
  misc_feature (387)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggccccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 280263 - DNA, 363 bp, Homo sapiens
  misc_feature: GYAE6OF02H211X.47.38.D05.1.454.CMB.1.raw
  modified_base (351)..(351): a, c, t, g, unknown or other
  misc_feature (351)..(351): n is a, c, g, or t
  modified_base (357)..(363): a, c, t, g, unknown or other
  misc_feature (357)..(363): n is a, c, g, or t
tcagagctcacgtacacgaccggtgctcgatttagtatctgatagttgggtttgggtggcccaagctgctggagggcgacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagccacctctggggccacagcggccctgggcctgcctggtcaaggacctacttcctagtgagctctgagcgggctggcaaggcncatagnnnnnnn

SEQ ID NO: 280264 - DNA, 364 bp, Homo sapiens
  misc_feature: GYAE6OF02HMW0A.47.38.D05.1.454.CMB.1.raw
  modified_base (360)..(364): a, c, t, g, unknown or other
  misc_feature (360)..(364): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctccccagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 280265 - DNA, 357 bp, Homo sapiens
  misc_feature: GYAE6OF02GZ4BP.47.38.D05.1.454.CMB.1.raw
  modified_base (353)..(357): a, c, t, g, unknown or other
  misc_feature (353)..(357): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctccgagagcacagcggccctgggctgcctggtcaaggactacttcctacgtgagctctgagcgggctggcaaggcgcatagnnnnn

SEQ ID NO: 280266 - DNA, 389 bp, Homo sapiens
  misc_feature: GYAE6OF02GTXF4.47.38.D05.1.454.CMB.1.raw
  modified_base (385)..(389): a, c, t, g, unknown or other
  misc_feature (385)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 280267 - DNA, 478 bp, Homo sapiens
  misc_feature: GYAE6OF02GO4NZ.47.38.D05.1.454.CMB.1.raw
  modified_base (468)..(478): a, c, t, g, unknown or other
  misc_feature (468)..(478): n is a, c, g, or t
tcagagctcacgtacacgaccggtgctcgatttagtatctgatagttgggtttgggtgcccaagctgctggaggacacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacgggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnnnnnn

SEQ ID NO: 280268 - DNA, 361 bp, Homo sapiens; identical to SEQ ID NO: 279966
  misc_feature: GYAE6OF02FWOMO.47.38.D05.1.454.CMB.1.raw
  modified_base (360)..(361): a, c, t, g, unknown or other
  misc_feature (360)..(361): n is a, c, g, or t

SEQ ID NO: 280269 - DNA, 473 bp, Homo sapiens
  misc_feature: GYAE6OF02FWVBK.47.38.D05.1.454.CMB.1.raw
  modified_base (462)..(473): a, c, t, g, unknown or other
  misc_feature (462)..(473): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaagggaccacggtcaccgtctcctcagcctcaccagggcccatcggtctcccctggcaccctcctccaagagcacctctgggggcacagcggccctgggctgcctggtcaaggactacttcctacgtgagctctgagcgggctgggcaggcgcatagnnnnnnnnnnnn

SEQ ID NO: 280270 - DNA, 390 bp, Homo sapiens
  misc_feature: GYAE6OF02HFQE7.47.38.D05.1.454.CMB.1.raw
  modified_base (385)..(390): a, c, t, g, unknown or other
  misc_feature (385)..(390): n is a, c, g, or t
tcagagctcacgtacacgaccggtgctcgatttagtatctgatagttgggtttgggtgcccaagctgctggagggcaggatcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttccccctggcaccctcctccaagagcacctctgggggcacagcggccctgggctgcctggtcaaggactacttcctatgtatactctgagcgggctggcaaggcgcatagnnnnnn

SEQ ID NO: 280271 - DNA, 644 bp, Homo sapiens
  misc_feature: GYAE6OF02H7YRU.47.38.D05.1.454.CMB.1.raw
  modified_base (197)..(197): a, c, t, g, unknown or other
  misc_feature (197)..(197): n is a, c, g, or t
  modified_base (335)..(335): a, c, t, g, unknown or other
  misc_feature (335)..(335): n is a, c, g, or t
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
tcagagctcacgtacacgaccggtgctcgatttagtatctgatagttgggtttggggtgagtcaggactcctcagttcaccttctcacaatgagctccctgctcagctcctgggctgctaatgctctgggtctctggatccagtgggatattgtgatgactcagtctccactctccctgcccgtccaccccgtgganacgcccggtcctaccatcctcctgcaaggtctacgccagacgcctcttacatagtaatggattcaacttattgaattggtaacctgacaagagcccagggtcaggtcctcacagcctcctgatcgttgtttgggtacngtagtccggcccgtccggggtcctggacgtagggttcaggttcggcaaggttcggattcgaggccacgaagtagtttaaccgtntacgtaaagtacgaaggttagggtaggacggngtaggtaggagttcggtttaggggtttataacggtttgacgtagtaggtacgtaagttaccgttaactaaaccgtttacctaactttaacgttttacggacccgttaacggggtaccgtaaggtaccgttagggaagtaacgttaacgaaacggttaaccgtagggttacggtaccgttacgaccgtaacccg

SEQ ID NO: 280272 - DNA, 538 bp, Homo sapiens
  misc_feature: GYAE6OF02GS95D.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccaggcagtctccacagctcctgatctgtttgggttctgatcgggcctccggggtccctgacaggttcagtggcagtggatcaggcacgagtattttacgctagaaaatcgagtagggtggaggctaggaggtagttggtttggggtttattacgtgctagtgactaaggttctaactaaaccttccttaactacgttttcggaccgtacggggacctagcgtaggaagtatacaaacgtaacgtgtggctagcaccatctcg

SEQ ID NO: 280273 - DNA, 389 bp, Homo sapiens; identical to SEQ ID NO: 279934
  misc_feature: GYAE6OF02F1YRE.47.38.D05.1.454.CMB.1.raw
  modified_base (386)..(389): a, c, t, g, unknown or other
  misc_feature (386)..(389): n is a, c, g, or t

SEQ ID NO: 280274 - DNA, 357 bp, Homo sapiens
  misc_feature: GYAE6OF02H23PY.47.38.D05.1.454.CMB.1.raw
  modified_base (354)..(357): a, c, t, g, unknown or other
  misc_feature (354)..(357): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcacccctcctccaagagcacctctgggggcacagcggccctgggctgcctggtcaaggactacttcctatgtatactctgagcgggctggcaaggcgcatagnnnn

SEQ ID NO: 280275 - DNA, 388 bp, Homo sapiens
  misc_feature: GYAE6OF02GN75N.47.38.D05.1.454.CMB.1.raw
  modified_base (382)..(388): a, c, t, g, unknown or other
  misc_feature (382)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggctactcctatgtatactctgagcggctggcaaggcgcatagnnnnnnn

SEQ ID NO: 280276 - DNA, 357 bp, Homo sapiens; identical to SEQ ID NO: 280247
  misc_feature: GYAE6OF02ICGZG.47.38.D05.1.454.CMB.1.raw
  modified_base (353)..(357): a, c, t, g, unknown or other
  misc_feature (353)..(357): n is a, c, g, or t

SEQ ID NO: 280277 - DNA, 363 bp, Homo sapiens
  misc_feature: GYAE6OF02JKOWW.47.38.D05.1.454.CMB.1.raw
  modified_base (358)..(363): a, c, t, g, unknown or other
  misc_feature (358)..(363): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagacgcacctctgggggcacagcggcctgggctgcctggtcaaggactactcctacgtgagctctgagcggctggcaaggcgcatagnnnnnn

SEQ ID NO: 280278 - DNA, 391 bp, Homo sapiens
  misc_feature: GYAE6OF02I0O3C.47.38.D05.1.454.CMB.1.raw
  modified_base (386)..(391): a, c, t, g, unknown or other
  misc_feature (386)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnnn

SEQ ID NO: 280279 - DNA, 406 bp, Homo sapiens
  misc_feature: GYAE6OF02H7XZG.47.38.D05.1.454.CMB.1.raw
  modified_base (391)..(392): a, c, t, g, unknown or other
  misc_feature (391)..(392): n is a, c, g, or t
  modified_base (394)..(406): a, c, t, g, unknown or other
  misc_feature (394)..(406): n is a, c, g, or t
tcagagctcacgtacacgaccggtgctcgatttagtatctgatagttggggtttgggtagcccaacgctggctggacgggcagggtcaccatgaccagggacacgtccatcagtacagcctacattggagctgagcagtctgagacctgacgacacggccgtgtattattgtgcgttaggttacggacgattacgacgttttgattggtcattacccggacgtgtggggcaaagggccacggtcaccgtctcctcagcctccaccaaggcccatcggtcttccccctggccaccctcctccaagagcacctctggggcacaggcggccctgggctgcctggtcaaggactacttcctacgtgagctctgagcggctggcaaggcgcatagnncnnnnnnnnnnnnn

SEQ ID NO: 280280 - DNA, 221 bp, Homo sapiens; identical to SEQ ID NO: 279954
  misc_feature: GYAE6OF02FTEY5.47.38.D05.1.454.CMB.1.raw
  modified_base (219)..(221): a, c, t, g, unknown or other
  misc_feature (219)..(221): n is a, c, g, or t

SEQ ID NO: 280281 - DNA, 553 bp, Homo sapiens
  misc_feature: GYAE6OF02IO57K.47.38.D05.1.454.CMB.1.raw
  modified_base (432)..(432): a, c, t, g, unknown or other
  misc_feature (432)..(432): n is a, c, g, or t
  modified_base (531)..(531): a, c, t, g, unknown or other
  misc_feature (531)..(531): n is a, c, g, or t
  modified_base (533)..(536): a, c, t, g, unknown or other
  misc_feature (533)..(536): n is a, c, g, or t
  modified_base (538)..(538): a, c, t, g, unknown or other
  misc_feature (538)..(538): n is a, c, g, or t
  modified_base (540)..(553): a, c, t, g, unknown or other
  misc_feature (540)..(553): n is a, c, g, or t
tcagagctcacgtacacgaccggtgctcgatttagtatctgatagttgggtttgggttgcccgaagctgctggagggcgacggtcaccacgctgcttgagtggatgggacggatcagccctaacagtggtggcgacaaactatgcacagaggtttcagggcaggggtcaccatgaccagggacacgtccatcagtacagcctacatggagctgagcagtctgagacctgacgacacggccgtgtattattgtgcgttagttacggacgtattacgacgttttgattggtcagttacccggactggtggggtcaaagggaccacggtcaccggtctccgtcacgcctccaccaagggtcccaatcggtccttccccctggcctacccctccctcaaacgcgccaccctcgtacgggggcaccaggccggcccnggggcctgcccgttgggtcaaacgggagtaccttcccgtaggttcaggcctctaggacgggccgggcctggggaccaaagggccgaccgtagaacggtncnnnngngnnnnnnnnnnnnnn

SEQ ID NO: 280282 - DNA, 355 bp, Homo sapiens
  misc_feature: GYAE6OF02H96T0.47.38.D05.1.454.CMB.1.raw
  modified_base (353)..(355): a, c, t, g, unknown or other
  misc_feature (353)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttccccctggcaccctcctccaagagcacctcgtgggggcacagcggccctgggctgcctggtcaaggactattccctacgtgagctctgagcgggctggcaaggcgcatagnnn

SEQ ID NO: 280283 - DNA, 480 bp, Homo sapiens
  misc_feature: GYAE6OF02FEQ9E.47.38.D05.1.454.CMB.1.raw
  modified_base (459)..(480): a, c, t, g, unknown or other
  misc_feature (459)..(480): n is a, c, g, or t
tcagagctcacgtacacgaccggtgctcgatttagtatctgatagttgggtttgggtgcccaagctgctggagggcacggtcaccacgctgctgagggagtagagtccctgagacctgacgacacggcctgtatattgtgcgttagttacggtacgattacgtacgtttgtagtggtctacgttaccggacggtggtaggggacgaaacggaccgacggtccaccgtctcctcacgcctcccgaccgaacgggtcccacgtcggttccccttcccccgtcggcctacccctcctaccgaacgacgcctaccgtccggtgggggaccacgaccggccggtccccgttgggccgttcggcccgtaggttaccgtaaggtaccctttaaccttccttaagtcgttaacgttactccggtaggacggcccggggtcgtaggaccgaacggggccagtaagtgnnnnnnnnnnnnnnnnnnnnnn

SEQ ID NO: 280284 - DNA, 479 bp, Homo sapiens
  misc_feature: GYAE6OF02FOK2V.47.38.D05.1.454.CMB.1.raw
  modified_base (466)..(479): a, c, t, g, unknown or other
  misc_feature (466)..(479): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggaccacggtcaccgtctcctcagcctccaccaagggcccatcggtcttccccctggcaccctcctccaagagcacctctggggcacagcggccctgggctgcctggtcaaggctacttcctacgtgagctctgagcgggctggcaaggcgcatagnnnnnnnnnnnnnn

SEQ ID NO: 280285 - DNA, 587 bp, Homo sapiens
  misc_feature: GYAE6OF02HQVSX.47.38.D05.1.454.CMB.1.raw
  modified_base (465)..(465): a, c, t, g, unknown or other
  misc_feature (465)..(465): n is a, c, g, or t
  modified_base (473)..(474): a, c, t, g, unknown or other
  misc_feature (473)..(474): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(490): a, c, t, g, unknown or other
  misc_feature (489)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
tcagagctcacgtacacgaccggtgctcgatttagtatctgatagttggggtttgggtgccaagcctgctggaggcagggtcacagtgaccagggacgaccgtccatcagtacctaggcctacatggagcttgagcacgtcgtacgagacctgacgacacggccgtagtattacttgtgcgttagttaccgacgtattacgacgttttgattggtactagttacccggacgtggtggggcaaacgggaccacggtcaccggtccgtcctcagcctccaccgaagggccatacggtctttaccccgtggtcgtacccgtcctccaagacgaccaccgtccgtacgggggcctacgaggacggtcccgtagggtcctaggtccgtgggtccaacggtacctacgttccgtacggtacgaggtccgtcctagacgcggggtctggcaacggcgcgactagctgacagntacgactnnacatgacnacntncnncnatntgtntatactatatatatagtatactacgtacgtacgtcgtacgtacgacgtacgacgtagtagacgtacgacgtacgtagtcgtcgtatac

SEQ ID NO: 280286 - DNA, 519 bp, Homo sapiens
  misc_feature: GYAE6OF02JB0ZX.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggtctgatcgggcctccggggtccctgacaggttcagtggcaggtggatcaggcacagtattttacgctagaaatcaggtagggtggaggcgtggaggtagttggtttaggggtttattacgtgtcatgctaagttctaactaacttcctactactttggccgagggaccagcgtaggagatacgaaacgtacgtgtcgctgcaccatctcg

SEQ ID NO: 280287 - DNA, 387 bp, Homo sapiens
  misc_feature: GYAE6OF02G2M04.47.38.D05.1.454.CMB.1.raw
  modified_base (385)..(387): a, c, t, g, unknown or other
  misc_feature (385)..(387): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnn

SEQ ID NO: 280288 - DNA, 409 bp, Homo sapiens
  misc_feature: GYAE6OF02JC6TC.47.38.D05.1.454.CMB.1.raw
  modified_base (389)..(409): a, c, t, g, unknown or other
  misc_feature (389)..(409): n is a, c, g, or t
tcagagctcacgtacacgaccggtgctcgatttagtatctgatagttgggtttgggtgcccaagctgctggagggcagggtcaccatgaccagggacacgtccatcagtacagcctacatgggagctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtacttccccctggcacccctcctccaagagcacctctggggcacgagccggccctgggctgcctggtcaaggctacgttcctacgtgagctctgagcgggctggcaaggcgcatagnnnnnnnnnnnnnnnnnnnnn

SEQ ID NO: 280289 - DNA, 364 bp, Homo sapiens
  misc_feature: GYAE6OF02JUVFS.47.38.D05.1.454.CMB.1.raw
  modified_base (357)..(364): a, c, t, g, unknown or other
  misc_feature (357)..(364): n is a, c, g, or t
tcagagctcacgtacacgaccggtgctcgatttagtatctgatagttgggttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggactactcctacgtgagctctgagcgggctggcaaggcgcatagnnnnnnnn

SEQ ID NO: 280290 - DNA, 388 bp, Homo sapiens
  misc_feature: GYAE6OF02F1ZFD.47.38.D05.1.454.CMB.1.raw
  modified_base (386)..(388): a, c, t, g, unknown or other
  misc_feature (386)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacaattacgacgtttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnn

SEQ ID NO: 280291 - DNA, 512 bp, Homo sapiens
  misc_feature: GYAE6OF02IS5V2.47.38.D05.1.454.CMB.1.raw
  modified_base (460)..(460): a, c, t, g, unknown or other
  misc_feature (460)..(460): n is a, c, g, or t
  modified_base (492)..(492): a, c, t, g, unknown or other
  misc_feature (492)..(492): n is a, c, g, or t
  modified_base (494)..(512): a, c, t, g, unknown or other
  misc_feature (494)..(512): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatggcacagaggttttcagggcagggtcaccatgaccagggacacgtccatcagtacagcctacatggagctgagcagtctgagacctgacgacacgggcctgtattattgtgcgttagttacggacgtattacgtacgttttgatttggtcattacccggacgtggtggggcaaaggggaccacggtcgaccggtctcctcacgcctccaccaagggcccaagtcggtcgttaccccctcggaccaccctcctccaacgagcacctcgtcggggcacacggccgccctgggctgcctggcaaggactacttcctacgtgacnctactgagcgggctgggcaagggcgcagtagnannnnnnnnnnnnnnnnnnn

SEQ ID NO: 280292 - DNA, 463 bp, Homo sapiens
  misc_feature: GYAE6OF02JUL4X.47.38.D05.1.454.CMB.1.raw
  modified_base (363)..(363): a, c, t, g, unknown or other
  misc_feature (363)..(363): n is a, c, g, or t
  modified_base (445)..(446): a, c, t, g, unknown or other
  misc_feature (445)..(446): n is a, c, g, or t
  modified_base (448)..(463): a, c, t, g, unknown or other
  misc_feature (448)..(463): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaagggaccacggtcacgtctctcagcctcacaggccatcgtctccctgcacctctccangcacctctggggcacgagcggcctgggctgcctggcaggactactctatgtatactctgagcgggctggcaaggcgcatagnngnnnnnnnnnnnnnnnn

SEQ ID NO: 280293 - DNA, 520 bp, Homo sapiens
  misc_feature: GYAE6OF02HJGFA.47.38.D05.1.454.CMB.1.raw
  modified_base (335)..(335): a, c, t, g, unknown or other
  misc_feature (335)..(335): n is a, c, g, or t
  modified_base (486)..(486): a, c, t, g, unknown or other
  misc_feature (486)..(486): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagccagagcctcttacatagtaatggattcaactatttgaattggtacctgcagagccagggcagtctccacagctcctgatctgtttggtctgatcggcctccggggtcctgacnggttcagtgcagtgatcaggcacagtatttacgctagaaatcgtaggtagggtggaggcgtgaggagttggtttaggggtttattacgtgtctagtgctaagttctaactaacttcctactacgtttcggccgtagggaccagctaggganatacaaacgactggtggctgacacctatcttacg

SEQ ID NO: 280294 - DNA, 175 bp, Homo sapiens
  misc_feature: GYAE6OF02G75VH.47.38.D05.1.454.CMB.1.raw
  modified_base (173)..(175): a, c, t, g, unknown or other
  misc_feature (173)..(175): n is a, c, g, or t
tcagagctcacgtacacgaccggtgctcgatttagtatctgatagttgggtttgggggaagaggaagactgacggtcccccaggagttcaggtgctgggcacagcggccctgggctgcctggtcaaggactacttcctacgtgagctctgagcgggctggcaaggcgcatagnnn

SEQ ID NO: 280295 - DNA, 365 bp, Homo sapiens; identical to SEQ ID NO: 279926
  misc_feature: GYAE6OF02GJ0U5.47.38.D05.1.454.CMB.1.raw
  modified_base (360)..(365): a, c, t, g, unknown or other
  misc_feature (360)..(365): n is a, c, g, or t

SEQ ID NO: 280296 - DNA, 480 bp, Homo sapiens
  misc_feature: GYAE6OF02GGWNG.47.38.D05.1.454.CMB.1.raw
  modified_base (468)..(480): a, c, t, g, unknown or other
  misc_feature (468)..(480): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaaggggaccacggtcaccgtctcctcagcctccaccaagggcccatcggtcttccccctggcaccctcctccaagagcacctcgtgggggcacagcggccctgggctgcctggtcaaggctacttcctacgtgagctctgagcgggctggcaaggcgcatagnnnnnnnnnnnnn

SEQ ID NO: 280297 - DNA, 387 bp, Homo sapiens
  misc_feature: GYAE6OF02FFSNQ.47.38.D05.1.454.CMB.1.raw
  modified_base (384)..(387): a, c, t, g, unknown or other
  misc_feature (384)..(387): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttcccctggcgccctgctccaggagcacctccgagagcacagcggccctgggctgcctggtcaaggactacttcctacgtgagctctgagcgggctggcaaggcgcatagnnnn

SEQ ID NO: 280298 - DNA, 368 bp, Homo sapiens
  misc_feature: GYAE6OF02JBA5L.47.38.D05.1.454.CMB.1.raw
  modified_base (362)..(368): a, c, t, g, unknown or other
  misc_feature (362)..(368): n is a, c, g, or t
tcagagctcacgtacacgaccggtgctcgatttagtatctgatagttgggtttgggttggtcccgaagctgctggagggcgacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcacccctcctcccaagacgcacctctcgggggcacgagcggccctgggctgcctggtcaaggctactcctacgtcgagctctgagcgggctggcaaggcgcatagnnnnnnn

SEQ ID NO: 280299 - DNA, 481 bp, Homo sapiens
  misc_feature: GYAE6OF02IG98E.47.38.D05.1.454.CMB.1.raw
  modified_base (472)..(481): a, c, t, g, unknown or other
  misc_feature (472)..(481): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggggcaaagggaccacggtcaccgtctcctcagcctccacaacgggcccatcggtcttccccctggccaccctcctccaagacgcacctctgggggccacagcggccctgggactgcctggtcaaggctacttcctacgtgagctctgagcgggctgggcaaggcgcatagnnnnnnnnnn

SEQ ID NO: 280300 - DNA, 594 bp, Homo sapiens
  misc_feature: GYAE6OF02J3EDX.47.38.D05.1.454.CMB.1.raw
tcagagctcacgtacacgaccggtgctcgatttagtatctgatagttgggtttggggaggactcctcagttcaccttctcacaatgaggctccctgctcagctccgtggggctgctaatgctctgggtctctggatccagtgggatattgtgatgactcagtctccagtctccctgcccgtcatcgttggagacgccggcctcatctcctgcaggtctagccagcgcctcctgcagactaatggaaactcctattggattcggacctgactaaagccgaggctagtcctccaacactcctgtacttctagtttgtcttttaagccgggtacccgtccgggtcctaggactcggttcacgtggcagtcggactcgaggcactagtattttacagtttacgaaactcgagacgaggtaggtagggacggtactaggacgtagtcgtacgttaggttaacgttttatacgtgtactagtcgaacgtaacgtaacctaaacgtaccttccttacgaccgttcggaccgtaggactacggtaacgtacggaactaacgttacgaaccgtaacgtcggacggtactcggactacgttacg

SEQ ID NO: 280301 - DNA, 388 bp, Homo sapiens
  misc_feature: GYAE6OF02HAFIW.47.38.D05.1.454.CMB.1.raw
  modified_base (385)..(388): a, c, t, g, unknown or other
  misc_feature (385)..(388): n is a, c, g, or t
tcagagctcacgtacacgaccggtgctcgatttagtatctgatagttgggtttggggtgccaagctgctggagggcacggtcaccatgaccagggacacgtccatcgagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcggctggcaaggcgcatagnnnn

SEQ ID NO: 280302 - DNA, 390 bp, Homo sapiens
  misc_feature: GYAE6OF02HF6CT.47.38.D05.1.454.CMB.1.raw
  modified_base (386)..(390): a, c, t, g, unknown or other
  misc_feature (386)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 280303 - DNA, 390 bp, Homo sapiens; identical to SEQ ID NO: 280302
  misc_feature: GYAE6OF02GAUTM.47.38.D05.1.454.CMB.1.raw
  modified_base (386)..(390): a, c, t, g, unknown or other
  misc_feature (386)..(390): n is a, c, g, or t

SEQ ID NO: 280304 - DNA, 551 bp, Homo sapiens
  misc_feature: GYAE6OF02GQOWG.47.38.D05.1.454.CMB.1.raw
  modified_base (410)..(410): a, c, t, g, unknown or other
  misc_feature (410)..(410): n is a, c, g, or t
  modified_base (540)..(540): a, c, t, g, unknown or other
  misc_feature (540)..(540): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagccagagcctcttacatagtaatggattcaactatttgaattggtacctgcagaagccagggcagtctccacagctcctgatctgtttgggttctgagtccgggccgtcccggggtccctgacgtaggttcacgtggcaggtggatcgaggcactagtattttacattagaaatcagcaagagtggaggntagacgatgctggtatttatacgtgactagtgactaagaacctaaaactaaacttcctttaccacccgtttaccggaccgaacgggtaaccaacggtacgtacgaactaagttacgacggtaacgttggnggactagaccg

SEQ ID NO: 280305 - DNA, 590 bp, Homo sapiens
  misc_feature: GYAE6OF02IXQA9.47.38.D05.1.454.CMB.1.raw
  modified_base (128)..(128): a, c, t, g, unknown or other
  misc_feature (128)..(128): n is a, c, g, or t
  modified_base (137)..(137): a, c, t, g, unknown or other
  misc_feature (137)..(137): n is a, c, g, or t
  modified_base (140)..(140): a, c, t, g, unknown or other
  misc_feature (140)..(140): n is a, c, g, or t
  modified_base (155)..(155): a, c, t, g, unknown or other
  misc_feature (155)..(155): n is a, c, g, or t
  modified_base (168)..(168): a, c, t, g, unknown or other
  misc_feature (168)..(168): n is a, c, g, or t
  modified_base (170)..(170): a, c, t, g, unknown or other
  misc_feature (170)..(170): n is a, c, g, or t
  modified_base (172)..(173): a, c, t, g, unknown or other
  misc_feature (172)..(173): n is a, c, g, or t
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
tcagagctcacgtacacgaccggtgctcgatttagtatctgatagttgggtttgggtgcccaagctcgctgggagggcacggttcaccacgctgcctcggagcgggtctggcaaggctcagtagctcngctcagtcngtnactgctgaggtctgngctcacgtccacncngnntgngcncgcggtccgngngctctctgngcncnctctgtntcgtctacactactcgtgncgcgtacgtcggtccgacgacgcgcggaggaggngtgtgttcgtcgtcgtacgtagtagtagtgtgtggtagtacgtctcgactactagtcgtcgtacgtcggtacggacggtacgtacgtacgtactactactaccgaacgaacgaaccgaaccgaccgaaccgaaaccgtaaccgtaacgtacgtacgtcgtacgtaacgtaacgtacgacgacgacgacgacgaaccgaccgacgacgacgcgtacgtgttactcgtagtacgacgacggacggtacgacgtacgtacttaccgtacctaccgtccgtccgtcgtacgtacggtacggtaccggtacggacggtacggtacgtacg

SEQ ID NO: 280306 - DNA, 473 bp, Homo sapiens
  misc_feature: GYAE6OF02HKWDL.47.38.D05.1.454.CMB.1.raw
  modified_base (465)..(473): a, c, t, g, unknown or other
  misc_feature (465)..(473): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctctccaagagcacctctgggggcacagcggccctgggctgcctggtcaaggactacttcctacgtgagctctgagcgggctggcaaggcgcatagnnnnnnnnn

SEQ ID NO: 280307 - DNA, 367 bp, Homo sapiens
  misc_feature: GYAE6OF02GA6NO.47.38.D05.1.454.CMB.1.raw
  modified_base (360)..(367): a, c, t, g, unknown or other
  misc_feature (360)..(367): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnnn

SEQ ID NO: 280308 - DNA, 394 bp, Homo sapiens
  misc_feature: GYAE6OF02GT7UH.47.38.D05.1.454.CMB.1.raw
  modified_base (388)..(394): a, c, t, g, unknown or other
  misc_feature (388)..(394): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattattgtgcgttagttacggacgattacgacgtttttgattggtcattacccggacgtgtggggcaaagggaccacggtcaccgtctcctcagcctccaccaagggcccatcggtcttccccctggccacccctcctccaagagcacctctgggggcacagcggccctgggctgcctggtcaaggctacttcctatgtatactctgagcgggctggcaaggcgcatagnnnnnnn

SEQ ID NO: 280309 - DNA, 389 bp, Homo sapiens
  misc_feature: GYAE6OF02HM51L.47.38.D05.1.454.CMB.1.raw
  modified_base (386)..(389): a, c, t, g, unknown or other
  misc_feature (386)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggcctgggctgcctggtcaaggactacttcctacgtgagctctgagcgggctggcaaggcgcatagnnnn

SEQ ID NO: 280310 - DNA, 357 bp, Homo sapiens; identical to SEQ ID NO: 280247
  misc_feature: GYAE6OF02HJVJF.47.38.D05.1.454.CMB.1.raw
  modified_base (353)..(357): a, c, t, g, unknown or other
  misc_feature (353)..(357): n is a, c, g, or t

SEQ ID NO: 280311 - DNA, 387 bp, Homo sapiens
  misc_feature: GYAE6OF02H07YP.47.38.D05.1.454.CMB.1.raw
  modified_base (384)..(387): a, c, t, g, unknown or other
  misc_feature (384)..(387): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggcctgggctgcctggtcaaggactacttcctacgtgagctctgagcgggctggcaaggcgcatagnnnn

SEQ ID NO: 280312 - DNA, 389 bp, Homo sapiens
  misc_feature: GYAE6OF02HRBYD.47.38.D05.1.454.CMB.1.raw
  modified_base (385)..(389): a, c, t, g, unknown or other
  misc_feature (385)..(389): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggccacggtcaccgtctcctcagcctccaccaagggcccatcggtcttccccctggcacccctcctccaagagcacctctgggggcacagcggccctgggctgccctggtcaaggctacttcctacgtgagctctgagcgggctggcaaggcgcatagnnnnn

SEQ ID NO: 280313 - DNA, 387 bp, Homo sapiens
  misc_feature: GYAE6OF02HV5JP.47.38.D05.1.454.CMB.1.raw
  modified_base (277)..(277): a, c, t, g, unknown or other
  misc_feature (277)..(277): n is a, c, g, or t
  modified_base (365)..(387): a, c, t, g, unknown or other
  misc_feature (365)..(387): n is a, c, g, or t
tcagagctcacgtacacgaccggtgctcgatttagtatctgatagttgggtttggggtgcccaagctgctcggagggcacggtcaccacgctgctggagcagtctgagtacctgacgacacggtccgtgtattattgtgcgttagttacggacgattacgacgttttgattggtcattacccggacgttgtggggcaaagggaccacggtcaccgtctcctcagcctccaccaagggcccagtccggtccttccccctggcctaccctcctccaagngcacctcgtggggcacagcggcccctgggctgcctggtcaaggactacttcctacgtgagctctgagcgggctggcaaggcgcatagnnnnnnnnnnnnnnnnnnnnnnn

SEQ ID NO: 280314 - DNA, 354 bp, Homo sapiens
  misc_feature: GYAE6OF02IX3G3.47.38.D05.1.454.CMB.1.raw
  modified_base (353)..(354): a, c, t, g, unknown or other
  misc_feature (353)..(354): n is a, c, g, or t
tcagagctcacgtacacgaccggtgctcgatttagtatctgatagttgggtttgggtgcccaagctgctggagggcacggtcaccacgctgctgagcagtctgagaccctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgccctggtcaaggctacttcctacgtgagctctgagcgggctggcaaggcgcatagnn

SEQ ID NO: 280315 - DNA, 391 bp, Homo sapiens
  misc_feature: GYAE6OF02HTC3Z.47.38.D05.1.454.CMB.1.raw
  modified_base (386)..(391): a, c, t, g, unknown or other
  misc_feature (386)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctggggctgcctggtcaaggactacttcctacgtgagctctgagcgggctggcaaggcgcatagnnnnnn

SEQ ID NO: 280316 - DNA, 547 bp, Homo sapiens
  misc_feature: GYAE6OF02HIEIT.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggttctgatcgggccctccggggtccctgacaggttcaggtggcagtggatcgaggcacagtattttacgctagaaaatcaaggtagggtggaggctggaggtagttggtttggggtttattacgtgctatgacaagtactaaaacctaaacttcctttacacccgttccggaccgaagggaccacggacgtacggaactaagttaacgacgtaactggtaggcttgactaaccg

SEQ ID NO: 280317 - DNA, 398 bp, Homo sapiens
  misc_feature: GYAE6OF02JG28U.47.38.D05.1.454.CMB.1.raw
  modified_base (386)..(398): a, c, t, g, unknown or other
  misc_feature (386)..(398): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcgccctgctccaggagcacctctgggggcacagcggccctgggctgcctggtcaaggactaccttcctacgtgagctctgagcgggctggcaaggcgcatagnnnnnnnnnnnnn

SEQ ID NO: 280318 - DNA, 358 bp, Homo sapiens
  misc_feature: GYAE6OF02IEK14.47.38.D05.1.454.CMB.1.raw
  modified_base (355)..(358): a, c, t, g, unknown or other
  misc_feature (355)..(358): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaaggcccatcggtcttcccctgcaccctctccaagagcacctctgggggcacagcggccctgggctgcctggtcaaggctacttcctacgtgagctctgagcgggctggcaaggcgcatagnnnn

SEQ ID NO: 280319 - DNA, 490 bp, Homo sapiens
  misc_feature: GYAE6OF02FQ83J.47.38.D05.1.454.CMB.1.raw
  modified_base (276)..(276): a, c, t, g, unknown or other
  misc_feature (276)..(276): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (346)..(347): a, c, t, g, unknown or other
  misc_feature (346)..(347): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagccagagcctcttacatagtaatggattcaactatttgaattggtaccttnagaagccagggcagtctccacagctcctgatctgtttggttctgatcgggctcgggccngcgngtngtgnngngntcagcanatnttagctanaatnagtaggngagngngagatgttgggttatactgnangtacattctactaacttctactattcgactagggacagctaggacgtatacgaaacgacgtcggnggtacncgaccactacg

SEQ ID NO: 280320 - DNA, 500 bp, Homo sapiens
  misc_feature: GYAE6OF02FF84G.47.38.D05.1.454.CMB.1.raw
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (472)..(472): a, c, t, g, unknown or other
  misc_feature (472)..(472): n is a, c, g, or t
  modified_base (479)..(481): a, c, t, g, unknown or other
  misc_feature (479)..(481): n is a, c, g, or t
  modified_base (483)..(500): a, c, t, g, unknown or other
  misc_feature (483)..(500): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggttttcaggggtcagggtcaccattgaccagggacacgtccatcagtacagcctanatggganctgagcaggtctgagacctgacgacacggccgtgtattattgtgcgttagttacggacgatttacgacgttttgattggtcattacccggacgtgtgggcaaaggggaccacggtcaccgtctcctcagccttccaccaagggcccatcggtcttccccctggcaccctcctccaacgagcacctctggggcacagcggccctgggctgcctggtcaacggactactttcctacgtgagctctgagcgggctggcaagggcncgatagnnngnnnnnnnnnnnnnnnnnn

SEQ ID NO: 280321 - DNA, 388 bp, Homo sapiens; identical to SEQ ID NO: 279958
  misc_feature: GYAE6OF02HOYB9.47.38.D05.1.454.CMB.1.raw
  modified_base (385)..(388): a, c, t, g, unknown or other
  misc_feature (385)..(388): n is a, c, g, or t

SEQ ID NO: 280322 - DNA, 362 bp, Homo sapiens
  misc_feature: GYAE6OF02IEKPA.47.38.D05.1.454.CMB.1.raw
  modified_base (360)..(362): a, c, t, g, unknown or other
  misc_feature (360)..(362): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgcctggtcaaggctacttcctacgtgagctctgagcgggctggcaaggcgcatagnnn

SEQ ID NO: 280323 - DNA, 480 bp, Homo sapiens
  misc_feature: GYAE6OF02HNM0F.47.38.D05.1.454.CMB.1.raw
  modified_base (471)..(480): a, c, t, g, unknown or other
  misc_feature (471)..(480): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagccggccctggggctgcctggtcaagggactacttcctacgttgagctctgagcgggctggcaaggcgcatagnnnnnnnnnn

SEQ ID NO: 280324 - DNA, 389 bp, Homo sapiens; identical to SEQ ID NO: 280266
  misc_feature: GYAE6OF02G44CL.47.38.D05.1.454.CMB.1.raw
  modified_base (385)..(389): a, c, t, g, unknown or other
  misc_feature (385)..(389): n is a, c, g, or t

SEQ ID NO: 280325 - DNA, 399 bp, Homo sapiens
  misc_feature: GYAE6OF02FWU21.47.38.D05.1.454.CMB.1.raw
  modified_base (387)..(399): a, c, t, g, unknown or other
  misc_feature (387)..(399): n is a, c, g, or t
tcagagctcacgtacacgaccggtgctcgatttagtatctgatagttggggtttgggtgcccaagctgctggagggcacggtcaccatgaccagggaccacgtccatcagtacagcctacatggagctgagcagtctgagacctgacgacacggccgtgtattattgtgcgttagttacggacgattacgacgtttttgattggtcattacccggacgtgtggggcaaagggccacggtcaccgtctcctcagcctccaccaagggcccatcggtctccccctggcaccctcctccaagagcacctctgggggcacagcggccctgggctgcctggtcaaggactacttcctacgtgagctctgagcgggctggcaaggcgcatagnnnnnnnnnnnnn

SEQ ID NO: 280326 - DNA, 358 bp, Homo sapiens
  misc_feature: GYAE6OF02IZZR5.47.38.D05.1.454.CMB.1.raw
  modified_base (352)..(358): a, c, t, g, unknown or other
  misc_feature (352)..(358): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactactcctacgtgagctctgagcgggctggcaaggcgcatagnnnnnnn

SEQ ID NO: 280327 - DNA, 518 bp, Homo sapiens
  misc_feature: GYAE6OF02G3PVD.47.38.D05.1.454.CMB.1.raw
  modified_base (502)..(503): a, c, t, g, unknown or other
  misc_feature (502)..(503): n is a, c, g, or t
  modified_base (505)..(518): a, c, t, g, unknown or other
  misc_feature (505)..(518): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtccttccccctggccaccctcctccaacgacgccacctccgtgggggcacgacgccggcccgtggggcctggcccgtggtcgaaagggtacctaccttccgttaacgtgagcctcgtgacggcgggctggccgaagggccgcacgtagnngnnnnnnnnnnnnnn

SEQ ID NO: 280328 - DNA, 482 bp, Homo sapiens
  misc_feature: GYAE6OF02G902A.47.38.D05.1.454.CMB.1.raw
  modified_base (474)..(482): a, c, t, g, unknown or other
  misc_feature (474)..(482): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggccaccctcctccaagacgcacctcgtcgggggcacgacgcggccctgggctgcctggtcaacggactacttcctacgtgagctctgagcgggctggcaaggcgcatgnnnnnnnnn

SEQ ID NO: 280329 - DNA, 240 bp, Homo sapiens
  misc_feature: GYAE6OF02GFFZ2.47.38.D05.1.454.CMB.1.raw
  modified_base (229)..(240): a, c, t, g, unknown or other
  misc_feature (229)..(240): n is a, c, g, or t
tcagagctcacgtacacgaccggtgctcgatttagtatctgatagttggggtttagggtgcccaagctgctggagggcacggtcaccgtctcctcagcctccaccaagggcccatccggtcttcccctggcaccctcctccaagagcacctctggggcacagcggcctgggctgcctggtcaaggactacttcctacgtgagctctgagcggctggcaaggcgcatagnnnnnnnnnnnn

SEQ ID NO: 280330 - DNA, 592 bp, Homo sapiens
  misc_feature: GYAE6OF02FV4SH.47.38.D05.1.454.CMB.1.raw
  modified_base (555)..(555): a, c, t, g, unknown or other
  misc_feature (555)..(555): n is a, c, g, or t
  modified_base (572)..(572): a, c, t, g, unknown or other
  misc_feature (572)..(572): n is a, c, g, or t
  modified_base (588)..(588): a, c, t, g, unknown or other
  misc_feature (588)..(588): n is a, c, g, or t
tcagagctcacgtacacgaccggtgctcgatttagtatctgatagttgggtttggttggcccaagcttgctggagggcacggtcaccacgctgcttgagtaggaatgggacggatcagccttaacagtcggtggctacgaaacgtagtcgccacagtagggttttccagggccagggtcaccgatgaccagggacacggtccagtccagtacagcctacatggagcctgacgcacgtctgacgtacctgacgacgacgggcccgttgtattattgtgcgttagttacggtacgtactttacgacggttttgagttggtccacttacccggaccgtggtggggctaaggggaccagggtcaccggtctccttcagccttccgaccaagggcccaatccggtacctttccccctggacctaccccgtcctccaacgtagcacccgtcgtacggggtcaccgaacgaccggaccctgggccttggcctggtacaaggcctacttccacgtcgacgctacgtgagcggtctggtccgaaggcgcgagtacgcagcacgngtcgtgtgctcgtctgngtgtcgcggcgacgangtcg

SEQ ID NO: 280331 - DNA, 369 bp, Homo sapiens
  misc_feature: GYAE6OF02IE9K9.47.38.D05.1.454.CMB.1.raw
  modified_base (364)..(369): a, c, t, g, unknown or other
  misc_feature (364)..(369): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcacccgtctcctcagcctccaccaagggcccatcggtcttccccctggccaccctcctccaagacgcacctctggggggcacagcggccctgggctgcctggtcaaggactacttcctacgtgagctctgagcgggctggcaaggcgcatagnnnnnn

SEQ ID NO: 280332 - DNA, 499 bp, Homo sapiens
  misc_feature: GYAE6OF02FVZV6.47.38.D05.1.454.CMB.1.raw
  modified_base (454)..(454): a, c, t, g, unknown or other
  misc_feature (454)..(454): n is a, c, g, or t
  modified_base (479)..(499): a, c, t, g, unknown or other
  misc_feature (479)..(499): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccggtctcctcagcctccaccaagggcccatcggtcttccccctggaccctccctccacgagcacctcctgggtcgacacgcggcccgtcggcgtcgcgtcggtcgacgacgtacttcctactgtatactctagngcggcgtcggcgacgcgcgactagnnnnnnnnnnnnnnnnnnnnn

SEQ ID NO: 280333 - DNA, 406 bp, Homo sapiens
  misc_feature: GYAE6OF02HXW2R.47.38.D05.1.454.CMB.1.raw
  modified_base (394)..(406): a, c, t, g, unknown or other
  misc_feature (394)..(406): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctcaccaagggcccatccggtcttccccctggccaccctcctccaagacgcacctcgtagggggcacacgcggcctgggctgcctggtcaaggactacttcctacgtgacgtctcgtgacgcgggctggcaaggcgacatagnnnnnnnnnnnnn

SEQ ID NO: 280334 - DNA, 483 bp, Homo sapiens
  misc_feature: GYAE6OF02GQ9ZT.47.38.D05.1.454.CMB.1.raw
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (432)..(432): a, c, t, g, unknown or other
  misc_feature (432)..(432): n is a, c, g, or t
  modified_base (465)..(465): a, c, t, g, unknown or other
  misc_feature (465)..(465): n is a, c, g, or t
  modified_base (467)..(483): a, c, t, g, unknown or other
  misc_feature (467)..(483): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaagggaccacggtcaccgtctcctcagcctccaccaagggcccatcggtcttccccngcaccctcctccaagncacctctggggcacagcggccctgggctgcctggtcaaggactacttcctacgtnacgctctgacgcgggctggcgaaggcgcatagnannnnnnnnnnnnnnnnn

SEQ ID NO: 280335 - DNA, 355 bp, Homo sapiens
  misc_feature: GYAE6OF02FISPU.47.38.D05.1.454.CMB.1.raw
  modified_base (353)..(355): a, c, t, g, unknown or other
  misc_feature (353)..(355): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccccctggcaccctcctccaagagcacctctgggggcacagcggccctgggctgcctggtcaaggctacttcctacgtgagctctgagcgggctggcaaggcgcatagnnn

SEQ ID NO: 280336 - DNA, 668 bp, Homo sapiens
  misc_feature: GYAE6OF02JKB18.47.38.D05.1.454.CMB.1.raw
  modified_base (272)..(272): a, c, t, g, unknown or other
  misc_feature (272)..(272): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagccagacgcctcttacatagtaatggattcaactatttgaattggttaaccntcgaacagacgacgagactacgccacgactcgtcctagtactcgttcggtttggttcgtcgtacggtccggtccgggtcccggtccggtcgacggtacgtcggtacgaggtcgacggtaggacgacgtacgacgtacgtagttacgttacgtacgtaacgtaacgtacgtaggtagggtagggaggtacggtaggtaggtaggttagggtttagggtttacgttacgtacgtgtacggtagtacgttacgttaaccgttaaccgttaaccgttaaccgttaacgttacgttaccggtaaccgggaaccgtaaccggtacgtacggtacggtaacgtaaccgttaacgtaaacggtacgtcggtacggtacgtaccgtacgaccgttacgtactacg

SEQ ID NO: 280337 - DNA, 479 bp, Homo sapiens
  misc_feature: GYAE6OF02GGGQC.47.38.D05.1.454.CMB.1.raw
  modified_base (470)..(479): a, c, t, g, unknown or other
  misc_feature (470)..(479): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttccttatgtatactctgagcgggctggcaagggcgcactagnnnnnnnnnn

SEQ ID NO: 280338 - DNA, 391 bp, Homo sapiens
  misc_feature: GYAE6OF02FFMMZ.47.38.D05.1.454.CMB.1.raw
  modified_base (383)..(391): a, c, t, g, unknown or other
  misc_feature (383)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattatttgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctggctgcctggcaaggctacttcctatgtatactctgagcgggctggcaaggcgcatagnnnnnnnnn

SEQ ID NO: 280339 - DNA, 579 bp, Homo sapiens
  misc_feature: GYAE6OF02FJEZ6.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctgggctgctaatgctctgggtctctggatccagtgggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctggtttggttctgactcggcctccggggtccctgacaggttcagtggcagtggatcgaggcacagtattttacgctagaaatcaggtagggtggaggcgtaggagggtagttgggtttgggttttaattacgttgacgtagttgactaagttactaaaccgtaaaccttaccttaacgtacgttttcggaccgtacggggtaccgtaaacggtcgtacggtaacgtaacgtaaccgaaacggtaacgttaggtacggaccgtacgacctaaccg

SEQ ID NO: 280340 - DNA, 621 bp, Homo sapiens
  misc_feature: GYAE6OF02HVTXL.47.38.D05.1.454.CMB.1.raw
  modified_base (427)..(427): a, c, t, g, unknown or other
  misc_feature (427)..(427): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagacgcctcttacatagtaatggattcaacttattgaattggtacctgcagaagccagggcagtctccacagtctcctgatcgtggtttggttctggtacgtccgggcccgttcccgggggtccctggaccgtagggttcaggtggcgtaggtgggatcgaggcacgagtagttttacgctagtaaatcgaggtaggggnggagtcgtggtagggtagttgggtttaggggtttaatttacgtaggtatagtgtacgttaacgttacttaaaccgttaaaccttcccttaaacgttacgttttacgggaccggtaacggggtaacctaacggtacgtaggggtaacgtaagtaaccgtaaacggtacgtggtacggtccgtacgacgtaacccg

SEQ ID NO: 280341 - DNA, 366 bp, Homo sapiens
  misc_feature: GYAE6OF02HSFHN.47.38.D05.1.454.CMB.1.raw
  modified_base (357)..(366): a, c, t, g, unknown or other
  misc_feature (357)..(366): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgtttttgattggtcattacccggacgtgtggggcaaagggaccacggtcaccgtctcctcagcctccaccaagggcccatcggtcttccccctggcaccctcctccaagagccacctcgtgggggcacagcggccctgggctgcctggtcaaggactacgttcctacgtgagctctgagcgggctggcaaggcgcatagnnnnnnnnnn

SEQ ID NO: 280342 - DNA, 359 bp, Homo sapiens
  misc_feature: GYAE6OF02JEA0N.47.38.D05.1.454.CMB.1.raw
  modified_base (353)..(359): a, c, t, g, unknown or other
  misc_feature (353)..(359): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnn

SEQ ID NO: 280343 - DNA, 384 bp, Homo sapiens
  misc_feature: GYAE6OF02I73NY.47.38.D05.1.454.CMB.1.raw
  modified_base (380)..(384): a, c, t, g, unknown or other
  misc_feature (380)..(384): n is a, c, g, or t
tcagagctcacgtacacgaccggtgctcgatttagtatctgatagttgggtttgggtgcccaagctgctggagggcaggatcaccatgaccagggacacgtccatcagtacagcctacatggagctgagcagtctgagacctgacgacacggccgtgtattattgtgcgttagttacggacgattacgacgttttgattggtcattacccggagtgtggggcaaagggccacggtcaccgtctcctcagcctcaccaaggcccatcggtctccccctggcacctcctccaagagcacctctgggggcacagcggccctgggctgcctggtcaaggactacttcctacgtgagctctgagcgggctggcaaggcgcatagnnnnn

SEQ ID NO: 280344 - DNA, 392 bp, Homo sapiens
  misc_feature: GYAE6OF02IL0S2.47.38.D05.1.454.CMB.1.raw
  modified_base (386)..(392): a, c, t, g, unknown or other
  misc_feature (386)..(392): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctggctgcctggtcaaggactacttcctacgtgagctctgagcgggctggcaaggcgcatagnnnnnnn

SEQ ID NO: 280345 - DNA, 491 bp, Homo sapiens
  misc_feature: GYAE6OF02JC1VL.47.38.D05.1.454.CMB.1.raw
  modified_base (435)..(435): a, c, t, g, unknown or other
  misc_feature (435)..(435): n is a, c, g, or t
  modified_base (470)..(472): a, c, t, g, unknown or other
  misc_feature (470)..(472): n is a, c, g, or t
  modified_base (474)..(491): a, c, t, g, unknown or other
  misc_feature (474)..(491): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgatttacgacgttttgattggtcattacccggacgtgtggggcaaagggaccacggtcaccgtctcctcagcctccacaagggccatcgtcttcccctggcaccctctccaagagcactctggggcacacgcggcctgggctgcctggtcaagggactacttcctaacgtgancctctgacgcgggctggcaagggtcgacagtacgnnngnnnnnnnnnnnnnnnnnn

SEQ ID NO: 280346 - DNA, 429 bp, Homo sapiens
  misc_feature: GYAE6OF02ICAS7.47.38.D05.1.454.CMB.1.raw
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (369)..(429): a, c, t, g, unknown or other
  misc_feature (369)..(429): n is a, c, g, or t
tcagagctcacgtacacgaccggtgctcgatttagtatctgatagttggggtttgggtgcccaagctgctggagggcacggtcaccacgctgctcgagcagtctgagacctgacgacacggccgtgtattattgtgcgttagttacggacggattacgacgtttttgattggtcattacccggacgtgtggggcaaagggaccacggtcaccgtctcctcagccctcgaccaagggcccatcggtcttccccctggcaccctcctcaagagcacctcgtggggggccacagcggccctgggctgcctggtcaaggactatcctacgtnacgctctgagcgggctggcaagggcgngagtagnangnagnnnnnnnnnnnnnnnnnnnnnnnnnnnnnnnnnnnnnnnnnnnnnnnnnnnnnnnnnnnnn

SEQ ID NO: 280347 - DNA, 547 bp, Homo sapiens
  misc_feature: GYAE6OF02F9ZV1.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctgaatccagtggggatattgtgatgactcagtctccactctccctgcccgtcacccctggagagccggcctccatctcctgcaggtctagccagagcctcttacatagtaatggattcaactatttgaaattggtacctgcagaagccagggcagtctccacagctcctgatctgtttggttctgatcggcctccggggtccctgacaggttcagtggcagtggatcgaggcacagtatttacgactagaaaatcgaggtagggtgggaggcgtggaggtagttggtttggggtttaatttacgtgtcagtgactaagttactaactaaacttactactacgttttcggacgacgggaccgtaaggacgtaggagtaacgtacaaacgtacgtagtaggctacgactaaccg

SEQ ID NO: 280348 - DNA, 626 bp, Homo sapiens
  misc_feature: GYAE6OF02IMHLP.47.38.D05.1.454.CMB.1.raw
  modified_base (473)..(473): a, c, t, g, unknown or other
  misc_feature (473)..(473): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtccacccctggagagcccggcctccatctcctgcaggtctagccagagcctcttacatagtaatggtattacaacttatttgaatttggtacctgcagaacgccgaggggcaggtctccacagcctcctgattcgttggttttgggtctgacgtccggcccgtccggggtccctgacgtaggttcaggtggctaggtggatcgaggcacgtagtactttacgctaagaaatcgaggtaggggtggaggtcgtaggtaggtagttgggtttaggggtttattacgtgtntagttgtactaagtttaccttaaccttaaacctttacccgttaacgttaccgttttacgggacccggtaacggggtaacccgtaacgggtccgtaagggaaggtacgtaacggtaacggtacggtaacgttcggtacggtccgtacgtacccg

SEQ ID NO: 280349 - DNA, 388 bp, Homo sapiens
  misc_feature: GYAE6OF02I5J0M.47.38.D05.1.454.CMB.1.raw
  modified_base (382)..(388): a, c, t, g, unknown or other
  misc_feature (382)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtgtggggcaaagggccacggtcaccgtctcctcagcctccaccaaggcccatcggtcttcccctggcaccctcctccaagagcacctctgggggcacagcggcctgggctgcctggtcaaggactactctacgtgagctctgagcgggctggcaaggcgcataggnnnnnnn

SEQ ID NO: 280350 - DNA, 366 bp, Homo sapiens
  misc_feature: GYAE6OF02JB17R.47.38.D05.1.454.CMB.1.raw
  modified_base (361)..(366): a, c, t, g, unknown or other
  misc_feature (361)..(366): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccccctggcaccctcctccaagagcacctctggggggcacagcggcccctgggctgcctggtcaaggctacttcctacgtgagctctgagcgggctggcaggcgcatagnnnnnn

SEQ ID NO: 280351 - DNA, 362 bp, Homo sapiens
  misc_feature: GYAE6OF02IX0DX.47.38.D05.1.454.CMB.1.raw
  modified_base (355)..(362): a, c, t, g, unknown or other
  misc_feature (355)..(362): n is a, c, g, or t
tcagagctcacgtacacgaccggtgctcgatttagtatctgatagttgggtttgggtgcccaagctgctggagggcacggtcaccacgctgctgagcagtctgagaccctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgccctggtcaaggactacttcctacgtgagctctgagcggctggcaaggcgcatagnnnnnnnn

SEQ ID NO: 280352 - DNA, 393 bp, Homo sapiens
  misc_feature: GYAE6OF02IU0VC.47.38.D05.1.454.CMB.1.raw
  modified_base (302)..(302): a, c, t, g, unknown or other
  misc_feature (302)..(302): n is a, c, g, or t
  modified_base (382)..(382): a, c, t, g, unknown or other
  misc_feature (382)..(382): n is a, c, g, or t
  modified_base (387)..(393): a, c, t, g, unknown or other
  misc_feature (387)..(393): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccacaacgggcccatcggtccttccccctggccacccctcctccaagngcacctctgggggcacagcggccctgggctgcctggtcaaggactacttcctacgtgagctctgagcggctggcgaggcnatagnnnnnnn

SEQ ID NO: 280353 - DNA, 405 bp, Homo sapiens
  misc_feature: GYAE6OF02I60IT.47.38.D05.1.454.CMB.1.raw
  modified_base (361)..(361): a, c, t, g, unknown or other
  misc_feature (361)..(361): n is a, c, g, or t
  modified_base (381)..(381): a, c, t, g, unknown or other
  misc_feature (381)..(381): n is a, c, g, or t
  modified_base (386)..(405): a, c, t, g, unknown or other
  misc_feature (386)..(405): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtccttcccctggcaccctcctccaagagccacctcgtggggcacagcggccctggctgcctggtcaaggctacttcctacggtgagctcnggacgcgggctggcaaggcnatagnnnnnnnnnnnnnnnnnnnn

SEQ ID NO: 280354 - DNA, 368 bp, Homo sapiens
  misc_feature: GYAE6OF02HGX0L.47.38.D05.1.454.CMB.1.raw
  modified_base (361)..(368): a, c, t, g, unknown or other
  misc_feature (361)..(368): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctgaccaccctcctccaagagcacctctgggggcacagcggccctgggctgcctggtcaaggactacttcctacgtgagctctgagcgggctggcaaggcgcatagnnnnnnnn

SEQ ID NO: 280355 - DNA, 398 bp, Homo sapiens
  misc_feature: GYAE6OF02IH96D.47.38.D05.1.454.CMB.1.raw
  modified_base (385)..(398): a, c, t, g, unknown or other
  misc_feature (385)..(398): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggccacggtcaccgtctcctcagcctccaccaagggcccatcggtcttccccctggcaccctcctccaagagcacctctgggggcacagcggcccgtgggctgcctggtcaaggactacttcctacgtgagctctgacgcggctggcaaggcgcatagnnnnnnnnnnnnnn

SEQ ID NO: 280356 - DNA, 527 bp, Homo sapiens
  misc_feature: GYAE6OF02IIG7P.47.38.D05.1.454.CMB.1.raw
  modified_base (337)..(337): a, c, t, g, unknown or other
  misc_feature (337)..(337): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtgggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggtctgatcggcctccggggtccngcaggttcagtgcagtgatcgagcacagtatttacgactagaaatcgaggtagggtggaggcgtggaggtagtggtttggggtttattacgtgctagtgactaagttctaactaacttcctaactacgtttcggaccgacgggtaccaaggcgtaggacgatacgaaacgtactggtcggctcgactacg

SEQ ID NO: 280357 - DNA, 510 bp, Homo sapiens
  misc_feature: GYAE6OF02HD1ES.47.38.D05.1.454.CMB.1.raw
  modified_base (490)..(510): a, c, t, g, unknown or other
  misc_feature (490)..(510): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggcgtgtgggcaaagggaccacggtcaccgtctcctcagcctccaccaacgggccatcggtccttcccctggccaccctcctccaagcgccacctcgtggggccacgtacgccggcccgtgggctcgccgtggtacgaacgggactacttcctagttcgtattacctctggagccgggctggccgaagggcgcagacgnnnnnnnnnnnnnnnnnnnnn

SEQ ID NO: 280358 - DNA, 508 bp, Homo sapiens
  misc_feature: GYAE6OF02HELTR.47.38.D05.1.454.CMB.1.raw
  modified_base (415)..(415): a, c, t, g, unknown or other
  misc_feature (415)..(415): n is a, c, g, or t
  modified_base (503)..(503): a, c, t, g, unknown or other
  misc_feature (503)..(503): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggttcagggcagggtcaccatgaccagggacacgtccatcagtacagcctanatgagctgagcagtctgagcctgacgacgacggcgtgtattagtggtcgcgttagtacggacgtagttacggacgttttgatttcggntacgg

SEQ ID NO: 280359 - DNA, 363 bp, Homo sapiens
  misc_feature: GYAE6OF02G9TQW.47.38.D05.1.454.CMB.1.raw
  modified_base (357)..(363): a, c, t, g, unknown or other
  misc_feature (357)..(363): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttcccccctggccaccctcctccaagagccacctctgggggcacagcggccctgggctgcctggtcaaggactacttcctacgtgagctctgagcgggctggcaaggcgcatagnnnnnnn

SEQ ID NO: 280360 - DNA, 519 bp, Homo sapiens
  misc_feature: GYAE6OF02HLG1X.47.38.D05.1.454.CMB.1.raw
  modified_base (460)..(460): a, c, t, g, unknown or other
  misc_feature (460)..(460): n is a, c, g, or t
  modified_base (515)..(515): a, c, t, g, unknown or other
  misc_feature (515)..(515): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcatcgttggagagccggcctccatctcctgcaggtctagccagagcctcctgcagactaatggaaatacctatttggattggtacctgacaaaagccagggcagtcctccacaactcctgatctatttggcttttaagcgggtcctccggggtccctgacagttcacgtggcagtggatcaggcacagtattttacatttagaaaatcagcagagtggagctgacgatgctggtatttattacgtgcatgacaagactaaacaacttccttacnccttacggaccgtaagggccaacggactagaacagttacgacgtaacgtggtcgntacg

SEQ ID NO: 280361 - DNA, 704 bp, Homo sapiens
  misc_feature: GYAE6OF02HZC78.47.38.D05.1.454.CMB.1.raw
  modified_base (543)..(543): a, c, t, g, unknown or other
  misc_feature (543)..(543): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtcctccactcctccctcgcccgtcacccccgtggacgacgcccggcctccactcctcctgcgaggtctagccagacgcctcctgacagactaagtaggaaaactacttagtttggtattcggtacctgaacaaaacgccgagggacagtcctaccaactacctcagtactcttagtttggttacttttaacgccgggtcccgttcccggggtccctagtacgtcggttaccacgtcggcgtaggtcgactcgaacgctaacgtaagttactttaagtaatttaacgaaacttcgaacggtactaagggtaaggtacgggtaaggtacgtacggtaaggtacgtcggttaacggtttagggtttaagttttaacgttacggtntaaccgtaagttaacgaaccgtaaacggttaaacccttaaaaccgttaaacccgtttccctttaaccgtaccggtttaaccggaaccgtaaacggccgtaacggtacgtaacggtaactagtaaccgacggtaacttggacgactcgactaccgtagttcg

SEQ ID NO: 280362 - DNA, 390 bp, Homo sapiens
  misc_feature: GYAE6OF02GQG0Y.47.38.D05.1.454.CMB.1.raw
  modified_base (384)..(390): a, c, t, g, unknown or other
  misc_feature (384)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcggctggcaaggcgcatagnnnnnnn

SEQ ID NO: 280363 - DNA, 619 bp, Homo sapiens
  misc_feature: GYAE6OF02GJ2MO.47.38.D05.1.454.CMB.1.raw
  modified_base (254)..(254): a, c, t, g, unknown or other
  misc_feature (254)..(254): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
tcagagctcacgtacacgaccggtgctcgatttagtatctgatagttgggtttgggtgcccaagctgctggaggcacggtcaccacgctgcttgagtggatgggaccggatcagccctaacagtggtggcacaaactagtgcacagaggtttcagggcaggtcaccatgaccagggacaccgttccatcgacgtacgacgcctacagtggagcctggagcagtcctgagaccctggaccgacaccgggtccgtntattattgtgtcgttagtacggacgtagttacgtacgtttgagttggtctacgttaccggtacggtggtcgggacgaacggaccgacggtccgaccgtccgtccgtccgacgtccgtaccgaaccgaaaccggcccgtacgtccggttcccgttcccccgtcggcccgtacccctacccgtaccgaacgacgcctacccgtcggtcgggacacgacggtccggcccgtcgggcgtcgtccgtacggtacgaacggtacctaccgttaccgtacgtcgtacgtcctacgtggacggccggtcgtcggtacgacggtacgacgtagtacgngnngncgncgcgngcgngngngtcgcgngcngcngc

SEQ ID NO: 280364 - DNA, 538 bp, Homo sapiens
  misc_feature: GYAE6OF02GB1LH.47.38.D05.1.454.CMB.1.raw
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (427)..(427): a, c, t, g, unknown or other
  misc_feature (427)..(427): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgngtggatgggacggatcagccctaanagtggtggcaacaaactatgacacagtaggtttcgagggcagggtcacgatcgacgagggacacgtcatcagtacagcctagagtggancgtgagacagtctagacgaccgtgaaccgacgacggtccgtagtacttagtgtacgtacgttaagttacggacgtagtttacggtacgttttgagtttcggtattaaccgg

SEQ ID NO: 280365 - DNA, 388 bp, Homo sapiens
  misc_feature: GYAE6OF02GPUKJ.47.38.D05.1.454.CMB.1.raw
  modified_base (384)..(388): a, c, t, g, unknown or other
  misc_feature (384)..(388): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccgtacgtgtggggcaaagggccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnnnn

SEQ ID NO: 280366 - DNA, 393 bp, Homo sapiens
  misc_feature: GYAE6OF02GXQ1T.47.38.D05.1.454.CMB.1.raw
  modified_base (386)..(393): a, c, t, g, unknown or other
  misc_feature (386)..(393): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnnn

SEQ ID NO: 280367 - DNA, 538 bp, Homo sapiens
  misc_feature: GYAE6OF02G0KAX.47.38.D05.1.454.CMB.1.raw
  modified_base (496)..(496): a, c, t, g, unknown or other
  misc_feature (496)..(496): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagccagagcctcttacatagtaatggattcaactatttgaattggtacctgcagaagccagggcagtctccacagctcctgatctgttggttctgatcgggcctccggggtcctgacaggttcagtggcaggtgatcaggcacagtatttacgctagaaatcgaggtagggtggaggctaggaggtagttggtttaggggtttattacgtgtactagtgtactaagttctaactaacttacctacttacgtttcggccgtagggaccagcgtagganaactacgaaacgtacgtaggtggtcgtgaccacctatctacg

SEQ ID NO: 280368 - DNA, 202 bp, Homo sapiens
  misc_feature: GYAE6OF02H96VJ.47.38.D05.1.454.CMB.1.raw
  modified_base (191)..(191): a, c, t, g, unknown or other
  misc_feature (191)..(191): n is a, c, g, or t
  modified_base (195)..(202): a, c, t, g, unknown or other
  misc_feature (195)..(202): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaatatgcacagaggtttcagggcaggtcaccatgaccaggacacgtccaatcagtacngtannnnnnnn

SEQ ID NO: 280369 - DNA, 400 bp, Homo sapiens
  misc_feature: GYAE6OF02HOXZ9.47.38.D05.1.454.CMB.1.raw
  modified_base (387)..(400): a, c, t, g, unknown or other
  misc_feature (387)..(400): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtgtgggcaaagggccacggtcaccgtctcctcagcctccaccaagggcccatcggtcttccccctggccacccctcctccaagacgcacctctgggggcacagcggccctgggctcgcctggtcaaggactacttcctacgtgagctctgagcggctggcaaggcgcatgnnnnnnnnnnnnnn

SEQ ID NO: 280370 - DNA, 556 bp, Homo sapiens
  misc_feature: GYAE6OF02H0ABY.47.38.D05.1.454.CMB.1.raw
  modified_base (296)..(296): a, c, t, g, unknown or other
  misc_feature (296)..(296): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaacttattgaattggtacctgcagaagccaggcagtctccacngctcctgatctgttggtctgatcggccgtccggggtcctgacaggttcaggtgcagtggatcgaggacacagtatttacgctagaaatcgaggtagggtaggaggctggaggtagttagggtttggggtttaattacgtgactagtgacgtaagttactaactaaaccttacctaacttacgtttacggaccgaacgggaaccaaggtcgtagggaacgtaactaacgaaacgtaacgttcggtaggtctacgctaaccg

SEQ ID NO: 280371 - DNA, 540 bp, Homo sapiens
  misc_feature: GYAE6OF02GJR57.47.38.D05.1.454.CMB.1.raw
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatgganctgagcagtctgacgacctgacgacacggccgtgtattattgtgcgttagtacggacgtattacgtacgttttgattggtctattacccggacgtggtggggcaaagggccacggtcaccgtctctcagtcttccaccaacgggcccatccgttcctcccctggccnccctgctccgaggcnccaccgtcgtggggcacgacggccggccgtgggctcggcctgggtccaaggcctacttccgtacgtgacgtctcgtgacggtccgggctgggaccgaacggccgacgtacgtacgcacgtncgangcncgactcncgngcncncgncncnncg

SEQ ID NO: 280372 - DNA, 584 bp, Homo sapiens
  misc_feature: GYAE6OF02JDZLV.47.38.D05.1.454.CMB.1.raw
  modified_base (250)..(250): a, c, t, g, unknown or other
  misc_feature (250)..(250): n is a, c, g, or t
  modified_base (406)..(406): a, c, t, g, unknown or other
  misc_feature (406)..(406): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagagcctggggcctcagtgaaggtctcctgcaaggcttcnggatacagcttcaccgactactatttgcactggtgcgacggccctggacgagggcttggagtggagtggggacggatcgagaccctaacgaggtggtggcaacaaactagtgcacgagacggtttacgagggcagggtcacgatggaccgaggacncgtacagtcagaccgagccctacagtggagcgtagagaccgtaggtctggacgtacctacggaccgaccgacgggtccgttagttacttagtttggttacggttaccggtttaacggttacggtaacgttaacgtttaccggttacggtttttaggacgtttcggtacgttaacccgg

SEQ ID NO: 280373 - DNA, 404 bp, Homo sapiens
  misc_feature: GYAE6OF02GZ1ZA.47.38.D05.1.454.CMB.1.raw
  modified_base (366)..(366): a, c, t, g, unknown or other
  misc_feature (366)..(366): n is a, c, g, or t
  modified_base (372)..(404): a, c, t, g, unknown or other
  misc_feature (372)..(404): n is a, c, g, or t
tcagagctcacgtacacgaccggtgctcgatttagtatctgatagttgggtttggggtgcccaagctgctggagggcacggtcacccacgctgctgagcagtctgagacctgacgacacggccgtgtattattgtgcgttaggttacggacgattacgacgttttgattggtcatttacccggacgtgtggggcaaagggaccacggtcaccgtctcctcagccgtccaccaagggccccatccgggtccttcccccctggccacccctcctccaagagcacctctgggggcacagcggccctgggctgccctggtcaagggactacgttccctacgtgagctcgtggagcgggctggcaaggcgnatagcnnnnnnnnnnnnnnnnnnnnnnnnnnnnnnnnn

SEQ ID NO: 280374 - DNA, 401 bp, Homo sapiens
  misc_feature: GYAE6OF02GTJKG.47.38.D05.1.454.CMB.1.raw
  modified_base (395)..(401): a, c, t, g, unknown or other
  misc_feature (395)..(401): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattatgtgcgttagttacggacgattacgacgttttgattggtcattacccggacgtgtggggcaaagggccacggtcaccgtctcctcagccctccaccaagggcccatccggtccttcccccctggccacccctcctcccaagagcacctctgggggcacgagccggccctgggctgcctggtcaaggactacttcctacgtgagctcgtgacgcgggctggcaaggcgcatagnnnnnnn

SEQ ID NO: 280375 - DNA, 577 bp, Homo sapiens
  misc_feature: GYAE6OF02JOD2T.47.38.D05.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
  modified_base (558)..(560): a, c, t, g, unknown or other
  misc_feature (558)..(560): n is a, c, g, or t
  modified_base (563)..(563): a, c, t, g, unknown or other
  misc_feature (563)..(563): n is a, c, g, or t
  modified_base (565)..(566): a, c, t, g, unknown or other
  misc_feature (565)..(566): n is a, c, g, or t
  modified_base (568)..(577): a, c, t, g, unknown or other
  misc_feature (568)..(577): n is a, c, g, or t
tcagagctcacgtacacgaccggtgctcgatttagtatctgatagttgggtttgggtgccaagctgctggagggcacggtcaccacgctgcttgagtggatgggacggatcagccctaacagtggtggcacaaactatgcacagaggtttcagggcagggtcaccatgaccagggacacgtccatcagtacagcctaanatgganctgagcagtctgacgacctgacgacacgggccgtgtatttattgtgtcgttagttacggacgtagttacgtacgtttgtattggtcagttaccgacggttggtggggcaagggaccacggtcaccgtctcctccagcctccgaaccgaacgggtcccaagtccggtcctttccccgtcggcctacccgtccctccaacgcgaccaccgtcgtggggccacgtacggccgcccgtggccgtcggccgtcggtccgtaaggaccttaaccgttccttacggtacgtacgtcgttccgtagtaccgggcggtccgttcggacgtaacgggcgaccgtaacgttcggcncgacgngnnngcncnngnnnnnnnnnn

SEQ ID NO: 280376 - DNA, 361 bp, Homo sapiens
  misc_feature: GYAE6OF02FLR0I.47.38.D05.1.454.CMB.1.raw
  modified_base (356)..(361): a, c, t, g, unknown or other
  misc_feature (356)..(361): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgccctggtcaaggactacttcctacgtgagctctgagcgggctggcaagggcgcatagnnnnnn

SEQ ID NO: 280377 - DNA, 561 bp, Homo sapiens
  misc_feature: GYAE6OF02IXI2D.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaacttatttagaattggtacctgacagaacgccagggcagtcctccacagctcctgatcttggtttggtctggacgtccgggtccgtccggggtccctggacgtaggttcaggtggcaggtggatcgaggcacagtatttacgctagaaatcgaggtagggtggaggcgtaggaggtagttgggtttagggtttatacgtgactagtcgactaagttacctaactaacttcctaacttcgttaggaccgtacgggaccaacgtcgtaggagtaactacgaaacgtacgtgtcggcttacgcctaaccg

SEQ ID NO: 280378 - DNA, 477 bp, Homo sapiens
  misc_feature: GYAE6OF02GUC01.47.38.D05.1.454.CMB.1.raw
  modified_base (126)..(126): a, c, t, g, unknown or other
  misc_feature (126)..(126): n is a, c, g, or t
  modified_base (448)..(448): a, c, t, g, unknown or other
  misc_feature (448)..(448): n is a, c, g, or t
  modified_base (456)..(457): a, c, t, g, unknown or other
  misc_feature (456)..(457): n is a, c, g, or t
  modified_base (460)..(460): a, c, t, g, unknown or other
  misc_feature (460)..(460): n is a, c, g, or t
  modified_base (462)..(477): a, c, t, g, unknown or other
  misc_feature (462)..(477): n is a, c, g, or t
tcagagctcacgtacacgaccggtgctcgatttagtatctgatagttgggtttgggttgcccaagctgctggagggcgagggtcaccatgaccagggacacgtccatcagtacagcctacatgganctggagcagtctgagacctggacgacgacggccgttgtatttattgtgtcggtttagttacggacgtatttacgagtttttgatttggtcattacccggagtggtggggacaaagggccacggtcaccggtctcctcacgccctaccgaccgaacgggcccaacgtccggtccttccccctcggcctacccctccctccaacgacgccacctcgtcgggggcacgacgcggcccgtggctcgccgtggtccaaggtctaccgttcctacgttacgacgtctacgtggtacgccgggtcgtcggtacgaaggccgcgtaaagnggtcagcnncgngnnnnnnnnnnnnnnnn

SEQ ID NO: 280379 - DNA, 625 bp, Homo sapiens
  misc_feature: GYAE6OF02HEIL3.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagccctcttacatagtaatggattcaacttatttgaattcggtacctgcaagaacgccgagggcacgtctccacgacgcctcctgtacttcgttggttttggggttcctggtacgttccggggtcccgttcccgggggtccctggaccgtagggttctagggttggacgtaggtggatcgaggactacgtagttactttacgacgtaagtaaaacgtcgtaggtagggtgggaggtcgtggaggtagttgggtttagggtttacttacgtgtctagtcgtacgtaagttactaacgtaaccttcttaccttacgtttcggaccgtacgggaccacgtcgtaggtacgaacgttaacgaaaccgtacgttggtacggtacgtcgtaccaccgtactcgttcg

SEQ ID NO: 280380 - DNA, 359 bp, Homo sapiens
  misc_feature: GYAE6OF02IEY5L.47.38.D05.1.454.CMB.1.raw
  modified_base (354)..(359): a, c, t, g, unknown or other
  misc_feature (354)..(359): n is a, c, g, or t
tcagagctcacgtacacgaccggtgctcgatttagtatctgatagttgggtttgggtgcccaagctgctggagggcacggtcaccacgctgctgagcagtctgagaccctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggcccctgggctgcctggcaaggctacttcctacgtgagctctgagcgggctggcaaggcgcatagnnnnnn

SEQ ID NO: 280381 - DNA, 470 bp, Homo sapiens
  misc_feature: GYAE6OF02G23Y8.47.38.D05.1.454.CMB.1.raw
  modified_base (465)..(470): a, c, t, g, unknown or other
  misc_feature (465)..(470): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcgtctcccctggcaccctcctccaagacgcacctctgggggcacagcggccctgggctgcctggtcaaggactacttcctacgtgagctctgagcgggctggcaaggcgcatagnnnnnn

SEQ ID NO: 280382 - DNA, 394 bp, Homo sapiens
  misc_feature: GYAE6OF02F0XRG.47.38.D05.1.454.CMB.1.raw
  modified_base (386)..(394): a, c, t, g, unknown or other
  misc_feature (386)..(394): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcataggnnnnnnnnn

SEQ ID NO: 280383 - DNA, 365 bp, Homo sapiens
  misc_feature: GYAE6OF02JB6TD.47.38.D05.1.454.CMB.1.raw
  modified_base (352)..(352): a, c, t, g, unknown or other
  misc_feature (352)..(352): n is a, c, g, or t
  modified_base (358)..(365): a, c, t, g, unknown or other
  misc_feature (358)..(365): n is a, c, g, or t
tcagagctcacgtacacgaccggtgctcgatttagtatctgatagttgggtttgggtggtcccgaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagacgcacctctgggggcacagcggccctgggctgcctggtcaaggactactcctacgtgagctctgagcgggctggcaagggcncatagnnnnnnnn

SEQ ID NO: 280384 - DNA, 412 bp, Homo sapiens
  misc_feature: GYAE6OF02HN7WL.47.38.D05.1.454.CMB.1.raw
  modified_base (386)..(386): a, c, t, g, unknown or other
  misc_feature (386)..(386): n is a, c, g, or t
  modified_base (402)..(412): a, c, t, g, unknown or other
  misc_feature (402)..(412): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttaagttacggacgattacgacgtttttgattggtcattacccggacgtgtggggcaaagggccacggtcaccgtctcctcagcctccaccaagggcccatccggtcttccccctggccaccctcctccaagacgcacctcgtcggggcacgacgccggcccgtgggctcgccgtggtaccaaggactaccttcctatgtatactctgacgcgggcnggcaaggcgacatagnnnnnnnnnnn

SEQ ID NO: 280385 - DNA, 392 bp, Homo sapiens
  misc_feature: GYAE6OF02GD4SY.47.38.D05.1.454.CMB.1.raw
  modified_base (296)..(296): a, c, t, g, unknown or other
  misc_feature (296)..(296): n is a, c, g, or t
  modified_base (383)..(392): a, c, t, g, unknown or other
  misc_feature (383)..(392): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaaggcccatcggtcttcccctggcaccctgctccaggncacctccgagagcacagccggccctgggctgcctggtcaaggctacttcctacgtgagctctgagcgggctggcaaggcgacatagnnnnnnnnnn

SEQ ID NO: 280386 - DNA, 577 bp, Homo sapiens
  misc_feature: GYAE6OF02FQPLF.47.38.D05.1.454.CMB.1.raw
  modified_base (399)..(399): a, c, t, g, unknown or other
  misc_feature (399)..(399): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (559)..(562): a, c, t, g, unknown or other
  misc_feature (559)..(562): n is a, c, g, or t
  modified_base (564)..(577): a, c, t, g, unknown or other
  misc_feature (564)..(577): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagaggtttcagggcagggtcaccatgaccagggacacgtccatcagtacagcctacatggagctgagcagtctgagacctgacgacacggccgtgtattattgtgtcgttagttacggacgattacgacgttttgattggtcattaccggacgtggtggggcaaagggaccacggtccaccgtctcctcacgcctccaccgaacgggcccagtccgggtccttccccccgtggccctacccctcctcccaagacnccaccctcgtcgggggcctacgcggccggcccgtgggctcggcccgttggtaccgtaacggaacccttaccgtttacccgttaaccgtggaacgtccgtcgtacgggacgggccggggtctcggggaccgtaaacgggccgaccgtaagtacgngngacnnnngnnnnnnnnnnnnnn

SEQ ID NO: 280387 - DNA, 578 bp, Homo sapiens
  misc_feature: GYAE6OF02F763R.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtgggatattgtgatgactcagtctccactctccctgcccgtcacccctggagagccggcctccatcctcctgcaggtctagccagacgcctcttacatagtaatggattacaacttatttgaattggtacctgacagaacgccgagggcagtctccacacgctcctgattcgttgtttgggtctgacgtccgggccgtccggggtcctgacgtaggttcaggtggcaggtggatcgaggcacagtatttacgctagaaatcgaggtagggtggaggcgtaggaggtagttaggtttagggtttattacgtgtctagtcgtacgtaagttactaacctaaacttccttactacgtttcggaccgtagggtaccgtaaggtcgtagggtaacgtacgtaacgtaacgtacgttagtcggtacgtacgacctaaccg

SEQ ID NO: 280388 - DNA, 390 bp, Homo sapiens; identical to SEQ ID NO: 280362
  misc_feature: GYAE6OF02HO2NG.47.38.D05.1.454.CMB.1.raw
  modified_base (384)..(390): a, c, t, g, unknown or other
  misc_feature (384)..(390): n is a, c, g, or t

SEQ ID NO: 280389 - DNA, 418 bp, Homo sapiens
  misc_feature: GYAE6OF02H2NEP.47.38.D05.1.454.CMB.1.raw
  modified_base (409)..(418): a, c, t, g, unknown or other
  misc_feature (409)..(418): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagccctccaccaagggcccatccggtcttccccctggccacccctcctccaagacgcacctcgtcgggggcacgaggccggcccgtggggctcgcccgtggtccaacggacctacttcctacgtgacgtctcgtgaggcgggctggcgaaggcgacatagnnnnnnnnnn

SEQ ID NO: 280390 - DNA, 495 bp, Homo sapiens
  misc_feature: GYAE6OF02ITVYL.47.38.D05.1.454.CMB.1.raw
  modified_base (455)..(455): a, c, t, g, unknown or other
  misc_feature (455)..(455): n is a, c, g, or t
  modified_base (478)..(495): a, c, t, g, unknown or other
  misc_feature (478)..(495): n is a, c, g, or t
tcagagctcacgtacacgaccggtgctcgatttagtatctgatagttgggtttgggtgcccaagcttctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggggcaaaggggaccacgggtcaccggtctcctcacgcctccacaaagggcccatcggtcttccccctggccaccctcctccaagacgcaccctctgggggccacagcggccctgggctgcctggtcaaggactacttcctattgtatactctgngcgggctggcaaggcgcagtagnnnnnnnnnnnnnnnnnn

SEQ ID NO: 280391 - DNA, 419 bp, Homo sapiens
  misc_feature: GYAE6OF02FKRVY.47.38.D05.1.454.CMB.1.raw
  modified_base (271)..(271): a, c, t, g, unknown or other
  misc_feature (271)..(271): n is a, c, g, or t
  modified_base (403)..(419): a, c, t, g, unknown or other
  misc_feature (403)..(419): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaaggggaccacggtcaccgtctcctcagcctccaccaagggccccatcggtcttcccccctggcaccctcctccaagacnccacctcggtcggggccacacggcccgcccggtggctcgccgtcggtacgaacggtaccttaccttacccgtacggtgacgtcctcgtaggacgggccgggtcgtcggaacggaacgggccgactaagtagnnnnnnnnnnnnnnnnn

SEQ ID NO: 280392 - DNA, 413 bp, Homo sapiens
  misc_feature: GYAE6OF02G0I04.47.38.D05.1.454.CMB.1.raw
  modified_base (383)..(383): a, c, t, g, unknown or other
  misc_feature (383)..(383): n is a, c, g, or t
  modified_base (389)..(394): a, c, t, g, unknown or other
  misc_feature (389)..(394): n is a, c, g, or t
  modified_base (396)..(413): a, c, t, g, unknown or other
  misc_feature (396)..(413): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctctcagcctccaccaaggcccatcggtcctcccctgcaccctcctccaagagcacctcgtggggcacgacgccggccctggcctgcctggtcaaggcctacgttcctatcgtactactctgacggcggctggcgaaggcncatagnnnnnntnnnnnnnnnnnnnnnnnn

SEQ ID NO: 280393 - DNA, 506 bp, Homo sapiens
  misc_feature: GYAE6OF02GXXZI.47.38.D05.1.454.CMB.1.raw
  modified_base (489)..(490): a, c, t, g, unknown or other
  misc_feature (489)..(490): n is a, c, g, or t
  modified_base (492)..(506): a, c, t, g, unknown or other
  misc_feature (492)..(506): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacgggccgtgtattattgtgcgttagttacggacgattacgacgttttgattggtcattacccggacgtgtgggggcaaagggccacggtcaccggtctcctcagcctccaccaagggcccatcggtcttccccctggccaccctcctccaagcgcaccctcgtcgggggcacgagccgggccctggggcctggcctggtcaagggtacctaccgttcctacgtggagctctggacgcgggctgggcaagggcgcatagnngnnnnnnnnnnnnnnn

SEQ ID NO: 280394 - DNA, 370 bp, Homo sapiens
  misc_feature: GYAE6OF02FVGPS.47.38.D05.1.454.CMB.1.raw
  modified_base (359)..(370): a, c, t, g, unknown or other
  misc_feature (359)..(370): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnnnnnnnnnnn

SEQ ID NO: 280395 - DNA, 380 bp, Homo sapiens
  misc_feature: GYAE6OF02HLGNL.47.38.D05.1.454.CMB.1.raw
  modified_base (362)..(380): a, c, t, g, unknown or other
  misc_feature (362)..(380): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaaggggaccacggtcaccgtctcctcagcctccaccaagggcccatcggtcttccccctggcaccctcctccaagagcacctctgggggcacagcggccctgggcctgcctggtcaaggactacttcctacgtgagctctgagcgggctggcaaggcgcatagnnnnnnnnnnnnnnnnnnn

SEQ ID NO: 280396 - DNA, 360 bp, Homo sapiens
  misc_feature: GYAE6OF02HDXLV.47.38.D05.1.454.CMB.1.raw
  modified_base (356)..(360): a, c, t, g, unknown or other
  misc_feature (356)..(360): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtccttccccctggccaccctcctccaagagcacctcgtgggggcacagcggccctgggctgcctggtcaaggactacttcctacgtgagctctgagcgggctggcaaggcgcatagnnnnn

SEQ ID NO: 280397 - DNA, 710 bp, Homo sapiens
  misc_feature: GYAE6OF02IALD2.47.38.D05.1.454.CMB.1.raw
  modified_base (165)..(165): a, c, t, g, unknown or other
  misc_feature (165)..(165): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (411)..(411): a, c, t, g, unknown or other
  misc_feature (411)..(411): n is a, c, g, or t
tcagagctcacgtacacgaccggtgctcgatttagtatctgatagttgggtttgggggttggtagtcgaggactcctcagttcaccttctcacaatgagctccctgctcagctcctgggctgactatgctctgggtctctggatccaggtggggacttattggtnagtgacctcagtctccactcctcccgtcgccctccaacccctggaacgngccgtcaccnctntccgtgaggtcacgcaagngtcctctatanataanggatcaatatttgaattggtactagcagaacgaccgagggctacgccttaccaagaggtaccctcggtaataggctttacgggtttttggtaaccgttttagggacggttttccccggccccgggttccgggggtttccctaaaccggnggttaaaccggggttttccgaaaggtcggggttcaagggttacggaggtttccggaaaggcccttaagaagtacgttttaacggtacctaagtaaaaccgtagtaaggtttacgggaagggtgggaccgtagggaggtagagggtttccgggtttaagttaggttcgatagttacgtctaaaggttaccttaacgtaaacgtttaaccctacttacggtttacgtaccggtacgggaacggttaaacgccggttggacgtaagaccgtaaaacgccgaagttcggatacggtctacaac

SEQ ID NO: 280398 - DNA, 415 bp, Homo sapiens
  misc_feature: GYAE6OF02HMOAA.47.38.D05.1.454.CMB.1.raw
  modified_base (404)..(415): a, c, t, g, unknown or other
  misc_feature (404)..(415): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtgtgggacaaagggccacggtcaccgtctcctcagcctccaccgaagggccccatccggtcttccccctggccacccctcctccaagacgcacctctgggggcacgagccggccctgggcctcggcctggtcaacggactaccttccgtacgtgagctcgtgagcgggcgtcggcgaaggcgcatagnnnnnnnnnnnn

SEQ ID NO: 280399 - DNA, 489 bp, Homo sapiens
  misc_feature: GYAE6OF02FGVXA.47.38.D05.1.454.CMB.1.raw
  modified_base (449)..(449): a, c, t, g, unknown or other
  misc_feature (449)..(449): n is a, c, g, or t
  modified_base (472)..(489): a, c, t, g, unknown or other
  misc_feature (472)..(489): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccacccctcctccaagacgcacctctcgggggcacagcggccctgggctgcctggtcaaggctacttcctacgtgacgctctgngcgggctgggcaaggcgcagtannnnnnnnnnnnnnnnnn

SEQ ID NO: 280400 - DNA, 364 bp, Homo sapiens
  misc_feature: GYAE6OF02HD986.47.38.D05.1.454.CMB.1.raw
  modified_base (359)..(364): a, c, t, g, unknown or other
  misc_feature (359)..(364): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggaccgattacgacgttttgattggtcattacccggacgtgtggggcaaagggccacggtcaccgtctcctcagcctccaccaagggcccatcggtcttccccctggcaccctcctccaagagcacctctgggggcacagcggccctgggctgcctggtcaaggctacttcctacgtgagctctgagcgggctggcaaggcgcatagnnnnnn

SEQ ID NO: 280401 - DNA, 360 bp, Homo sapiens
  misc_feature: GYAE6OF02G4Z9Z.47.38.D05.1.454.CMB.1.raw
  modified_base (351)..(360): a, c, t, g, unknown or other
  misc_feature (351)..(360): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctggggcacagcggccctggctgcctggtcaaggactacttcctacgtgagctctgagcgggctggcaggcgcatagnnnnnnnnnn

SEQ ID NO: 280402 - DNA, 369 bp, Homo sapiens
  misc_feature: GYAE6OF02HCR7S.47.38.D05.1.454.CMB.1.raw
  modified_base (362)..(369): a, c, t, g, unknown or other
  misc_feature (362)..(369): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccgaagggcccatccggtccttcccccctggccacccctcctccaagagccacctcgtgggggcacagcggccctgggctgcctggtcaaggtactacttcctacgtgagctctgagcgggctggcaaggcgcatagnnnnnnnn

SEQ ID NO: 280403 - DNA, 360 bp, Homo sapiens
  misc_feature: GYAE6OF02I8O3W.47.38.D05.1.454.CMB.1.raw
  modified_base (353)..(360): a, c, t, g, unknown or other
  misc_feature (353)..(360): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttccccctggcaccctcctccaagagcacctctgggggcacagcggccctgggctgcctggtcaaggactacttcctacgtgagctctgagcgggctggcaaggcgcagtagnnnnnnnn

SEQ ID NO: 280404 - DNA, 436 bp, Homo sapiens
  misc_feature: GYAE6OF02HRI1B.47.38.D05.1.454.CMB.1.raw
  modified_base (251)..(251): a, c, t, g, unknown or other
  misc_feature (251)..(251): n is a, c, g, or t
  modified_base (413)..(436): a, c, t, g, unknown or other
  misc_feature (413)..(436): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgatttggtcattacccggacgttgtggggcaaagggcccacggtcaccgtctcctnagcctccaccaagggcccatccggtccttccccctggccacccctcctaccaagcgccacctcgtggggcacgacgcggccctgggctcgcctggtcaaggtacctacttccctacggtcgagtctcgtgacggcgggactggcaacggcgacctagtacgnnnnnnnnnnnnnnnnnnnnnnnn

SEQ ID NO: 280405 - DNA, 416 bp, Homo sapiens
  misc_feature: GYAE6OF02HV9C3.47.38.D05.1.454.CMB.1.raw
  modified_base (395)..(397): a, c, t, g, unknown or other
  misc_feature (395)..(397): n is a, c, g, or t
  modified_base (399)..(416): a, c, t, g, unknown or other
  misc_feature (399)..(416): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagccctccaccaagggcccatccggtcttccccctggccacccctcctccaagagcacctcgtgggggcacagcggccctgggctgcctggtcaaggactacttcctacgtgagctctgagcgggctggcgaacggcgacataggnnngnnnnnnnnnnnnnnnnnn

SEQ ID NO: 280406 - DNA, 804 bp, Homo sapiens
  misc_feature: GYAE6OF02F66LM.47.38.D05.1.454.CMB.1.raw
  modified_base (220)..(220): a, c, t, g, unknown or other
  misc_feature (220)..(220): n is a, c, g, or t
tcagagctcacgtacacgaccggtgctcgatttagtatctgatagttgggtttgggggtagggacgtccgtcagttcaccttctcacaatgaggctccctgctcagctcctgggctgctaatgctctggtcgtctggatccagtgggatagttgtgatgactcagtctccactcctccctcgccctccgggggggacccctcggacgacgccggcctccnctcctcctcgcacggtctacgccagacgcctcttacactagtaagtgtatactaacttattataagttcggttaccgtgtacgaagaacgccgtaggcgacgtccgtaccacgacgtcctacgtacgtacttcgttggtttcggtttcgtaggtacgtccgggtcccggtcccggggtacccgtcggacgtacggttacgtacggtcggacgtaggtcggacgtacgtagacgacgtaacgtaacgttttaccgtacgtaagtaaaacgtacgtaagggtacggggttagggtacgggtacggttagggaagggttaggttttaggggtttacgggggtttttaactttacggggtaccgttagaacggttacgttaaccggttaaacgttttaccgtaaaaccgtttaaacccgtttacccgtttaaaccgtttacggtttaacccgggtaaccgggtaaccggggttaacccggtaacggttacggtaaacggggtaacttaacggtaaacccgtaaaaccggtaaccggtttacggtacgggtacttaaccggtacgtaacccgttacgttaccgttaccg

SEQ ID NO: 280407 - DNA, 632 bp, Homo sapiens
  misc_feature: GYAE6OF02GROWB.47.38.D05.1.454.CMB.1.raw
  modified_base (363)..(363): a, c, t, g, unknown or other
  misc_feature (363)..(363): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcaagtctccacagctcctgactctgtttgggttctgagtcgggcctccgggtcctgacaggttcagtgcagtgatcgagcanagtatttacgactagaaaatacgtaggtagggtggaggtacgtggaaggtagttaggtttaggggttttaagttacgttagtacgtagttacggtactaaacgtttaccgtaaacttaaaaccgtttccgttaaaccgttaccgtttttacgggacccgtaacgggggtaacccgtaaacggtacgtacgggaaagtaaccgttaaaccgaaaacgttaaacgtacggtacgggtacgtcggaaccgtacccgtaacgttcgttaccgg

SEQ ID NO: 280408 - DNA, 365 bp, Homo sapiens
  misc_feature: GYAE6OF02JB8DL.47.38.D05.1.454.CMB.1.raw
  modified_base (352)..(352): a, c, t, g, unknown or other
  misc_feature (352)..(352): n is a, c, g, or t
  modified_base (358)..(365): a, c, t, g, unknown or other
  misc_feature (358)..(365): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggccaccctcctccaagacgcacctctgggggcacagcggccctgggctgcctggtcaaggactacttcctacgtgagctctgacggcgggctggcaaggcncatagnnnnnnnn

SEQ ID NO: 280409 - DNA, 710 bp, Homo sapiens
  misc_feature: GYAE6OF02JGXS7.47.38.D05.1.454.CMB.1.raw
tcagagctcacgtacacgaccggtgctcgatttagtatctgatagttgggtttggggagggactcctcagttcaccttctcacaatgaggctccctgctcagctcctggggctgctaatgctctgggtctctggatccagtggggatattgtgatgactcagtctccactctccctgcccgtcacccctggacgagccggcctccatcctcctgacaggtctagccagacgcctcttacatagtaatggattacaactatttgaattggtacctgcagaagccgagggcagtcctaccacgacgctcctagacttcgttggttttcgggttctgacggttccgggccgttccggggtccctaggaccgtagggttcaggtcggactaggtgacgtcgaagggcctacagttacgttttacgacgtaagaaaagtacgtaaggttaggggtaggagggtacgtagggtaacggtaggtttacgggttttaggggtttaacgtttacgtaggtaccgtaggttacgttaaccgttaacgggtttaacctaaacccgttaaaccgtttacccgtttaaaccgttaccggtttttaccgggaaccggttaaccggggtaaccgtagtaccgggtagggtaacggtaacgttaaccgtaaaccggtaacgttcgggtacggtccgtacggtacctacccgttacttccgttacgg

SEQ ID NO: 280410 - DNA, 521 bp, Homo sapiens
  misc_feature: GYAE6OF02GXSPF.47.38.D05.1.454.CMB.1.raw
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (476)..(476): a, c, t, g, unknown or other
  misc_feature (476)..(476): n is a, c, g, or t
tcagagctcacgtacacgaccggtgctcgatttagtatctgatagttggggtttggggaggactcctcagttcaccttctcacaatgaggctccctgctcagctcctggggctgctaatgctctgggtctctggatccagtggggatattgtgatgactcagtctccactctccctgcccgtcaccctggagagccggctccatctcctgcaggtctagccagagcctcttacatagtaatggattcaactatttgaattgtacctgcagaagccaggcagtctccanagctccngatctgttgggtctgatcggcctcgggtcctgacnggttcagtgcagtgatcaggcacanatttagctagaaaatcaagtaggngagntgngagtgttgggtttattatgtacatgactaagttataacgtaaacttacctaacgtactttcggaccgaaggggtaccaagtcgtaggganaacgtacaaaccgtaacgtggtacggcgtcgacacctatcgtacg

SEQ ID NO: 280411 - DNA, 466 bp, Homo sapiens
  misc_feature: GYAE6OF02H7WBR.47.38.D05.1.454.CMB.1.raw
  modified_base (430)..(466): a, c, t, g, unknown or other
  misc_feature (430)..(466): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgtattacgacgtttttgatttggtcattaccccggagtggtggggacaaagggaccacggtcaccgtctcctcagccctccaccaagggccccatccggtcttccccctggccacccctcctccaagacgccaccgtcgtgggggcacgagccggccctgggcctcgcctgggtacaaggacctaccgttcctacggtcgacgtcctcgtgtacggcggggtactcgggacgaaggccgacaagtgagnnnnnnnnnnnnnnnnnnnnnnnnnnnnnnnnnnnnn

SEQ ID NO: 280412 - DNA, 636 bp, Homo sapiens
  misc_feature: GYAE6OF02HY7CX.47.38.D05.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtgggatattgtgatgactcagtctccactctccctgcccgtcacccctggagngccggcctccatctcctgcaggtctagccagacgcctcttacataagtaatggattcaacttatttgaattggtacctgcaggaancccgaggggcaggttctcccacacgtcctcctgattcgtttggttttcggggttctaggacgttcccggggtcccgttcccgggggtccctaggtaccgtagggtttcaggttcgggactaggttcgggaatcgaaggcctaacgtaaggtacttttacgacttaaggaaacttgacgggttagggtcgggcggcgtaggtagggtagttgggtttaggggtttaatacgtggctagtgacgtaacgttactaacctaacttcgtaaccttacgttttacgggaccgtaaggggtacctaaggcggttaggaacgtaactacgtaaacgacgtggtacggtcgtcgacgtacg

SEQ ID NO: 280413 - DNA, 551 bp, Homo sapiens
  misc_feature: GYAE6OF02FNANE.47.38.D05.1.454.CMB.1.raw
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (535)..(537): a, c, t, g, unknown or other
  misc_feature (535)..(537): n is a, c, g, or t
  modified_base (539)..(551): a, c, t, g, unknown or other
  misc_feature (539)..(551): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgaccgacacggccgtgtattattgtgtcgttagttacggacgtatttacgtacgttttgagtttggtctacgttacccggtacggtggtggggacaaacgggaccacggtcaccgtcctcctcacgcctccaccgaacggccacgtcggtccttcccctcgccacccgtcctccaacgacgccaccgtcgtcggggcacgcggccggcccgtagggcctcggccgtcggtaccgaacgggtaccttaccttacccgttacgtcgaacgtcctcctagcggcggacgtggcgaaggccgacagtacgncngcnnngnnnnnnnnnnnnn

SEQ ID NO: 280414 - DNA, 528 bp, Homo sapiens
  misc_feature: GYAE6OF02FPN3D.47.38.D05.1.454.CMB.1.raw
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
  modified_base (452)..(453): a, c, t, g, unknown or other
  misc_feature (452)..(453): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(479): a, c, t, g, unknown or other
  misc_feature (478)..(479): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
tcagagctcacgtacacgaccggtgctcgatttagtatctgatagttgggtttggggtgcccaagctgctggagggcagggtcaccatgaccaggggaccacgtccatcagtacaggccttacatggagctgagcagtactgagacctgacgacacggccgtgtattattgtcgcgttagttacggacgattacgacgtttttgattggtcattacccggagtgtgggcaaagggccacggtcaccgtctcgtcagcctcacaaggccatcgcttcccctaggctacctcctacaagacgcaccgtcgtggggaccacgacggcggcccgtgggctaggtccctgggtcaaggccttacttcctacgttgaagtcgtccgtgacggcgggtactggacgtaaaggcgaccgtaagttaggnacgcaattcgtatacanacgcagnagacganngtnacacanatntactacnananannatanctcntactctcgacgagananagatagagacacngcgacgacanc

SEQ ID NO: 280415 - DNA, 640 bp, Homo sapiens
  misc_feature: GYAE6OF02G4HYU.47.38.D05.1.454.CMB.1.raw
  modified_base (395)..(395): a, c, t, g, unknown or other
  misc_feature (395)..(395): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagccagacgcctcttacatagtaatggattcaacttatttgaatttggtacctgacagaagccgagggcagtcctccacagctcctgattcgttggtttgggttctgtacgtccgggtcccgttccgggggtccctagacgtaggttcgaggttgcaggtggatcgagcanagtactttacgactagtaaatcgtaaggtagggtaggaggtcgtaggtaagggtagttagggtttaggggttttaacttagtacgtacgtagttacgtacgttaaacgtttaccttaaaccgttaaacctttaccgttaacgttaacgttttacgggaccggtaacggggtaaccgtaaggtaccgtagggtaacgtaacgttaacgaaacgtaacgttacggtacggtacgtacgacctaaccg

SEQ ID NO: 280416 - DNA, 405 bp, Homo sapiens
  misc_feature: GYAE6OF02I5S5P.47.38.D05.1.454.CMB.1.raw
  modified_base (400)..(405): a, c, t, g, unknown or other
  misc_feature (400)..(405): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcacccctcctccaagagcacctctgggggcacagccggccctggggctcgcctcggtcaacggacttaccttcctaacggtgagcctctgaggcgggctgggcgaaggtcgcatgnnnnnn

SEQ ID NO: 280417 - DNA, 655 bp, Homo sapiens
  misc_feature: GYAE6OF02IO91F.47.38.D05.1.454.CMB.1.raw
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagagctcacgtacacgaccggtgctcgatttagtatctgatagttgggtttggggaggacgtcctcagttcaccttctcacaatgaggctccctgctcagctcctgggctgctaatgctctgggtctctggatccagtggggatattgtgatgactcagtctccactctccctgccccgtcaccccctggacgacgcccggcctccatctcctgcaggttctagccagacgcctacttacatagtaatggtattcaactattagaatttggacctgctaagaacgccgagggcagtcctaccacgagtccgtcctgacttctgttttggtctgacgtcgggccgtcgggtccctgactggttcacggttgacagtgntcgacggtcanagttactttacgacgtaagaaacgttcgaaggtagggttaggaggtacgtaggaaggtacgtttagggtttacgggtttaacgttacgttcgtacacgttggtaaccgttaacgtttaccgtaaacgttaaaccgtttaccgttacttaaccggttttacggaccgggttaaacgggaacccgtaggtcggtacggtaacgtaacgttaaccgaaaacgttaccgttggtaccggtactcggtaccctaaccttactacgttacg

SEQ ID NO: 280418 - DNA, 529 bp, Homo sapiens
  misc_feature: GYAE6OF02FP962.47.38.D05.1.454.CMB.1.raw
  modified_base (526)..(526): a, c, t, g, unknown or other
  misc_feature (526)..(526): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcctgcagactaatggaaatacctatttggattggtacctgacaaaagccagggcagtctccacaactcctgatcttatttggtcttttaagtccgggccttcccgggggtccctggactaggttcactggcaggtggatcgaggcacagtattttacattagaaatcagcagtaggtggaggctgacgatgcgtggtagtttatactgcagtcgactaagactaaactaacttcctttacaccttcggacaaggcacgagtggactagtagacgtaactggtacgctagctaccgtntcg

SEQ ID NO: 280419 - DNA, 667 bp, Homo sapiens
  misc_feature: GYAE6OF02GKGJK.47.38.D05.1.454.CMB.1.raw
  modified_base (309)..(309): a, c, t, g, unknown or other
  misc_feature (309)..(309): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccagtgggatattgtgatgactcagtctccactctccctcgcccgtcaccccgtggagacgccggcctccatcctcctgcaggtctagccagacgccttcttacatagtaatggtattacaacttatttgaatttcggtacctgacaagaacgccgagggcacgtcctccganacgtcctccgtagacttcgttggttttcgggtctggtacgtcccgggtccgttcccggggtcctggtaccgtaggttccaggtcggacgtaggtggactcggaggctacgtaagttacgtttacgacgtaaggtaaactcggtaaggtaggggtacggtacggtacgtaggaggttaggtttgggttttacgggttttaattacgtgtacgtagtcgtactaacgtttacctaacttaaccttaccttaacgttacgtttaccggaccggtaacgggacctaggtcgtacgggaacgtaaccgttaacgaaaccgtacgttacggtacgtacgtacgacctaccgtcgttacgttacg

SEQ ID NO: 280420 - DNA, 216 bp, Homo sapiens
  misc_feature: GYAE6OF02I0SGJ.47.38.D05.1.454.CMB.1.raw
  modified_base (214)..(216): a, c, t, g, unknown or other
  misc_feature (214)..(216): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcataccgacgtnnn

SEQ ID NO: 280421 - DNA, 749 bp, Homo sapiens
  misc_feature: GYAE6OF02G5MXU.47.38.D05.1.454.CMB.1.raw
  modified_base (159)..(159): a, c, t, g, unknown or other
  misc_feature (159)..(159): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctcgtgggtcctctggatccaggtggggatattgngatgactcacgtctccactcctccctcgcccgtccaccccgtggacgacgcccggtcctccactcctccgtcgcgtacggtcctacgaccgagacgtcccctccgtcgacgaacgtaacttaagtaacggtaaaacttccttaagtttagggacttcggtaacctggaaacaaaacggtccggagggacctacgtacctacccacctaaccgttcctagtacttacttaggtttacgtactttaaccggccggtccgtacccgggtctaggaacgttcggtactacgtgacgtggttacgaactcggaacgtacaacgttagttaattttaacgaaagtttaacgtaaaagtccgtaagtacgtaaaggtcgggtacggtacggtacgtaacggacgtaacggtcggtacgggttacgtaacgttttagtaacgtgtaactacggttaacgaacgtaaactaacccgttaaaacctaccctttccgttaacccgttaccgtacgggaaccgtaacgggtaaccgaaccgtaacgtaacgtaccgttaagttaaccggaacggtacgttacggacgtacccgtagtaaccc

SEQ ID NO: 280422 - DNA, 517 bp, Homo sapiens
  misc_feature: GYAE6OF02G9IQG.47.38.D05.1.454.CMB.1.raw
  modified_base (511)..(517): a, c, t, g, unknown or other
  misc_feature (511)..(517): n is a, c, g, or t
tcagagctcacgtacacgaccggtgctcgatttagtatctgatagttgggtttggggtgcccaagctgctaggagggcacgggtcaccacgcttcttgagtggatgggacggatcagccctaacagtggtggcacaaactatggcacagagggttttcagggcaggggtcaccatgaccaggggacacgtccatcagtacagcctacatggagctgagcagtctgagacctgacgacacggccgtgtattattgtgcgttagttacggacgattacgtacgttttgattggtcattacccggacgtgtggggcaagggaccacggtcaccgtctcctcagcctccacctaacgggcccatccggtcctcccccgtggccaccctcctccaacgacgccacctcgtgggggcacgacggccgggcccgtggggctggcctggtacaacgggtacttaccttcctatcgtactactctgacggccgggtctgggacgtaacggcgacataggnnnnnnn

SEQ ID NO: 280423 - DNA, 625 bp, Homo sapiens
  misc_feature: GYAE6OF02I6Q95.47.38.D05.1.454.CMB.1.raw
  modified_base (299)..(299): a, c, t, g, unknown or other
  misc_feature (299)..(299): n is a, c, g, or t
tcagagctcacgtacacgaccggtgctcgatttagtatctgatagttgggtttggggaggactcttcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagacgccttcttacatagtaatggattcaacttatttgaattggtacctgacagaacgccgagggcagtcctccacncgctctgattcttggtttggttctgacgtccgggtaccgtcccggggtcctagacgtaggttccaggtggctaggtggactcgaggcaacgtagtactttacgactaagaaagtacgtaagggtaggggtaggagggtacgtaggagggtagttgggttttagggttttaacttacgtgtactagttcgacgttaacgttacctaacgtaacctttaccttacgttacggtttcggaaccgtaacgggaaccgtaggtcgtagggtaacgtaacgttaaacgacgttacggtaggtctacggacctacctacgttccttagttacc

SEQ ID NO: 280424 - DNA, 369 bp, Homo sapiens
  misc_feature: GYAE6OF02I6QVF.47.38.D05.1.454.CMB.1.raw
  modified_base (273)..(273): a, c, t, g, unknown or other
  misc_feature (273)..(273): n is a, c, g, or t
  modified_base (360)..(369): a, c, t, g, unknown or other
  misc_feature (360)..(369): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtctccccctggccaccctcctccaagngcacctctgggggcacagcggccctgggctgcctggtcaaggactacttcctacgtgagctctgagcgggctggcaaggcgcatagnnnnnnnnnn

SEQ ID NO: 280425 - DNA, 390 bp, Homo sapiens
  misc_feature: GYAE6OF02HC1U0.47.38.D05.1.454.CMB.1.raw
  modified_base (381)..(381): a, c, t, g, unknown or other
  misc_feature (381)..(381): n is a, c, g, or t
  modified_base (387)..(390): a, c, t, g, unknown or other
  misc_feature (387)..(390): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggaccacggtcaccgtctcctcagcctccaccaagggcccatcggtcttccccctggccgccctgctccaggagcacctccgagagcacagcggccctgggcctgcctggtcaaggactacttcctacgtgagctctgagcgggctggcaaggcncatagnnnn

SEQ ID NO: 280426 - DNA, 452 bp, Homo sapiens
  misc_feature: GYAE6OF02H3T2D.47.38.D05.1.454.CMB.1.raw
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (425)..(452): a, c, t, g, unknown or other
  misc_feature (425)..(452): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgagttttgatttgttcattacccgggacgtgtggggacaaagggaccacggtcaccgtctcctcagcctcaccaagggccatccggtcttccccctggccaccctcctaccgaagacnccacctcgtgggggccaacgcgccgcctcgggctcgtaccgtggacaaggaccttacttcctacggtcgaagtccttcncggaacggcgggaccgtcggacgaacggcgactagtagngnnnnnnnnnnnnnnnnnnnnnnnnnnnn

SEQ ID NO: 280427 - DNA, 665 bp, Homo sapiens
  misc_feature: GYAE6OF02H30XS.47.38.D05.1.454.CMB.1.raw
  modified_base (579)..(579): a, c, t, g, unknown or other
  misc_feature (579)..(579): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggatattgtgatgactcagtctccagtcctccctgcccgtcatcgttggagcgccggtcctccatcctcctgccgaggtctagccgaagacgccttcccaggccagaacctaaagtaggaaaattaacctaatttagggtattaggtacctaggaacaaaacgccgagggcacgtcctaccaacaaacctcctgtactcttaatttggtcttttaaagtccgggtaccttccgggggtcctgaccgtaggttcaacgtggtaccaggtggaactcgtaacggactaaccgtaggtaattttttaaccaagtttaagaaaattccgaaagacgtagtaaggtgtaaggcctaggaacgagtgtacgtaggtagtttaagttacctaggtactaacgtagaccgaaagtaccgtaaaaaccttaaacttcccctttanacccgtttacggacctaaacgggactacgtaactacggtactaagtttaacgacgtaagtacggtggtacctagtaccacctaacg

SEQ ID NO: 280428 - DNA, 799 bp, Homo sapiens
  misc_feature: GYAE6OF02IAMKM.47.38.D05.1.454.CMB.1.raw
tcagagctcacgtacacgaccggtgctcgatttagtatctgatagttgggtttggggaggactcctcagttcaccttctcacaatgaggctcccctgctcagctcctggggctgctaatgctctgggtctctggatccgaggtggggatattgtgatgactcagtcctccactcctccctcgccccgtcaccccgtggacgacggcccggcctccatcctcctgcgtaggtactagccagacgccttacttacatagtaatggtattacaacttatttagaagtttggtacctgacaagaacgccgagggctacgtcctacacgacgcttcctgtattcgttaggtttcggtctaggtacgtccgggccgttccggggtccctagacgtcggttcgaggtcggacgaggtgactacggagccaagtacgttaactttacgacgttaacgtaaacgtcgtaagggttagggtagggtaccgggtagtagggaggttaaggtttaggggtttttacgggtttttaagttacggttacgtacgtaacggttacgtaaccgttaaacggttttacctaaaaccgttttaaacccgttaccgttttaaaccgttttaccggttttaacggggacccgggtaaacgggggttaaccccgtaagggttaccggttaacggggtaacgttaaaccggtaaacccggtaaaaacccgggtttaacccggttaggggtttaacccggggtacccgttaccggtaaccccgttaaccccggttttaagttaccccggtttttaacccggg

SEQ ID NO: 280429 - DNA, 719 bp, Homo sapiens
  misc_feature: GYAE6OF02JKPGF.47.38.D05.1.454.CMB.1.raw
tcagagctcacgtacacgaccggtgctcgatttagtatctgatagttgggtttggggtggatcaggactcctcagttcaccttctcacaatgaggctccctgctcagctcctggggctgctaatgctctgggtctctggatccagtggggatattgtgatgactcagtctccactcctccctgccccgtccaccccgtggacgacggcccggcctccatcctcctaggcaggtcctagccacgacgtcctacttacattaagtaactggtacttacaacttatttagtaagttcgtacctgacaaggacgcgagggctacgtccaccacgacgtcctcctagactttcgttggtttcggttcaggtaccgtcgggtacccgtccgggtacctgaacgtgtcaggtcgatagggtagacctcgacgtacgtacgttaacgttacgtttacgtacgtaaacggtaaacgtacggtaaggggttaaggggtacgggtaacggtcgggttaaggtacgggtttagggtttacgggtttttaggggttttaacctacgggtgtaaccggttacgttaacggttaccgttaaacgttacccgtttaaaccttaaccgtttaccgttaccgttacgtttaccgggaccgttagggtaaccgtacggtaggtacggtagtaacgtaacgaaaccgtcggtaggtaccggtacgtacaccgttaaccg

SEQ ID NO: 280430 - DNA, 582 bp, Homo sapiens
  misc_feature: GYAE6OF02G6UV7.47.38.D05.1.454.CMB.1.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagccgtggggcctcgaggtgaaggtctccgtgcgaaggtccttcgtggatacgacgtcttaccaccgtaacttactatttcgctacgtgggtgccggaccggccccgtggacgaaggcttggagtggagtgggacgtntcgacgccgtaagnggtggcggacacaaatngacagagtaggttcgagggctagggcaccgagcgaccgaggacacgtccatacgagtacncgacctaacgntggagcgtagagctagtctgacgtaccgtagaccggacgacggtccgtagttagttgttggtacgttcgttacggtacggttacgtacggtttaccgtggttttacggtagttcggttacgttaccggg

SEQ ID NO: 280431 - DNA, 538 bp, Homo sapiens
  misc_feature: GYAE6OF02FX21D.47.38.D05.1.454.CMB.1.raw
  modified_base (515)..(515): a, c, t, g, unknown or other
  misc_feature (515)..(515): n is a, c, g, or t
  modified_base (520)..(523): a, c, t, g, unknown or other
  misc_feature (520)..(523): n is a, c, g, or t
  modified_base (525)..(538): a, c, t, g, unknown or other
  misc_feature (525)..(538): n is a, c, g, or t
tcagagctcacgtacacgaccggtgctcgatttagtatctgatagttgggtttgggtgcccaagctgctggagggcacggtcaccacgctgcttgagtggatgggacgtatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgatttacgacgttttgattggtcattacccggacgtgtgggggcaaagggacccacggtcaccgtctcctcacgcctccaccagggcccatccggtcttccccctggccacccctcctccaacgacgccaccctcgtcgggggccacacggccggccctgggctcgcccgttggtacaagggtacctactttcccgtaacgtgacgccttcgtgacggcggggtcgtgggaccgaagggccgcgaagttacgntgacnnnngnnnnnnnnnnnnnn

SEQ ID NO: 280432 - DNA, 577 bp, Homo sapiens
  misc_feature: GYAE6OF02F657A.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccgagggcagtcctccacagctcctgattcgttggttttggttctgagtccgggtcccgtccgggggtccctggacgtggttcgaggtcgcagtggatcgaggcacgagtattttacgctaagaaatcgaggtagggtggaggcgtggaggtagttgggtttagggtttattacgtgacgtatgactaagttactaacgtaaacctttacctacgttaccgtttcggaccgtaacgggaccaaggtcgtaggtagtaacaacgtaaacgtacgttacggtcgtcgtcgacctaaccg

SEQ ID NO: 280433 - DNA, 419 bp, Homo sapiens
  misc_feature: GYAE6OF02JFNYR.47.38.D05.1.454.CMB.1.raw
  modified_base (264)..(264): a, c, t, g, unknown or other
  misc_feature (264)..(264): n is a, c, g, or t
  modified_base (404)..(404): a, c, t, g, unknown or other
  misc_feature (404)..(404): n is a, c, g, or t
  modified_base (410)..(419): a, c, t, g, unknown or other
  misc_feature (410)..(419): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtctagttacccggacgttggtgggggaccaaaaggggaccacgggtcacccggtctcccgtnacgccctccaaccgaacgggccccatcggtccttccccctggccacccctcctccaagacgcacctctgggggcacagccggccctgggcctgcctggtcaggactacttccgtacgtgagctctgagcggctgcaggcncatagnnnnnnnnnn

SEQ ID NO: 280434 - DNA, 750 bp, Homo sapiens
  misc_feature: GYAE6OF02IRVRD.47.38.D05.1.454.CMB.1.raw
  modified_base (278)..(278): a, c, t, g, unknown or other
  misc_feature (278)..(278): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccaggtgggatattgtgatgactcagtctccactcctccctgcccgtcaccccgtggacgacgcccggcctccattcctccgtgcctaggtcctacgcccaaggacgtccttcttaacataacgtagtggattaccaaacttntttgaacgtttggtacctggaccaggaacgccgtaggggctacgtcctcccgaactaaccgtcctagacttacgttagtttcggtactttttaacggccgggtcccgttacccgggggttccctaggtaccgtacggtttccacgttcggacgtaggttcgactcggaacggtccaactacgtttacttttaacgaagtttaagaaattcgacgacgtaaggtgggtaacgggcgtacgtacgacgtagttcgtacgttagggttaacgttttacgttacgtagtacgtaacgttaccggtaactaacgttaaaccgttaaacccgtaaaacgttttccccgtttacggtaacccgttacccgggtaccgaaaccgggttccaacccgggtaacggtttacggaaacttacgttaaaccgaacgggttaccgttacgggtccggttaccgtacgtacccgtaaccttcccgg

SEQ ID NO: 280435 - DNA, 409 bp, Homo sapiens
  misc_feature: GYAE6OF02HYEOZ.47.38.D05.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (319)..(319): a, c, t, g, unknown or other
  misc_feature (319)..(319): n is a, c, g, or t
  modified_base (391)..(409): a, c, t, g, unknown or other
  misc_feature (391)..(409): n is a, c, g, or t
tcagagctcacgtacacgaccggtgctcgatttagtatctgatagttgggtttgggtgcccaagctgctggagggcagggtcaccatgatcagggacacgtccatcagtacagcctacatggagctgagcagtctgagacctgacgacacggccgtgtattatgtgcgttagtacggacgattacgagttttgattggtcattacccggngtgtggggacaaaagggccaggtcaccgtctcctnagcctccaacgaaggccatcggtcttcccctggcaccctcctccaagagcacctctgggggcacacgcggcccngggctgcctggtcaaaggactaacttctaacgtgacgctcgtgacgcggggctggacaagggcgcaagtagnnnnnnnnnnnnnnnnnnn

SEQ ID NO: 280436 - DNA, 533 bp, Homo sapiens
  misc_feature: GYAE6OF02HLPZK.47.38.D05.1.454.CMB.1.raw
  modified_base (483)..(483): a, c, t, g, unknown or other
  misc_feature (483)..(483): n is a, c, g, or t
  modified_base (510)..(510): a, c, t, g, unknown or other
  misc_feature (510)..(510): n is a, c, g, or t
  modified_base (517)..(518): a, c, t, g, unknown or other
  misc_feature (517)..(518): n is a, c, g, or t
  modified_base (520)..(533): a, c, t, g, unknown or other
  misc_feature (520)..(533): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattaccggacgtgtggggcaaagggaccacggtcaccgtctcctcagcctccaccgaagggcccatccggtccttccccctaggccaaccctcctccaacgacgcacctcgtggggccacaggccggcccgtgggctcgccgtggtcgaacggaccttacgttccctaacggttcgacgtcctacgtgtaggccgggtntacgggccaaagggccgctaagtcgangcagcgnngnnnnnnnnnnnnnn

SEQ ID NO: 280437 - DNA, 420 bp, Homo sapiens
  misc_feature: GYAE6OF02INQNH.47.38.D05.1.454.CMB.1.raw
  modified_base (403)..(404): a, c, t, g, unknown or other
  misc_feature (403)..(404): n is a, c, g, or t
  modified_base (406)..(420): a, c, t, g, unknown or other
  misc_feature (406)..(420): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgatttggtcattacccggacgtgtggggcaaagggccacggtcaccgtctcctcagcctccaccaagggcccatcggtcttccccctggccacccctcctccaagacgcacctcgtgggggccacgacggccggccccgtggggctcggcctggtcaaggactacttcctacgtgagctcgtgacgcgggctggcaaggcgcatagnngnnnnnnnnnnnnnnn

SEQ ID NO: 280438 - DNA, 586 bp, Homo sapiens
  misc_feature: GYAE6OF02F7A5I.47.38.D05.1.454.CMB.1.raw
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctggaggtgaagaagcctggggcctcagtgaaggtctcctgcaaggcttctggatacagtcttacaccgactactatttgcacgtgggtgcgaccgggcccctggacgagggcttgagtggagtgggacgatcgacgcccgtaagagtggtacggcaacgaaactatacgcaacgaggtaggtttacgacgggacgtaggggtccaaccgtagtcggaaccgaagggacaccgtccaatccgagtacacgacctacgagtgacgctagagcgagtgtcggacgacctgacgacgacggtccgttatacgttagttggtacgttacggttaggtaccggtaacgttagttacggttacggttttagacgtttcggtacttaaccgg

SEQ ID NO: 280439 - DNA, 414 bp, Homo sapiens
  misc_feature: GYAE6OF02I6BDH.47.38.D05.1.454.CMB.1.raw
  modified_base (389)..(389): a, c, t, g, unknown or other
  misc_feature (389)..(389): n is a, c, g, or t
  modified_base (396)..(414): a, c, t, g, unknown or other
  misc_feature (396)..(414): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatccggtcttccccctggccaccctcctccaagagcacctctggggcacagcggccctgggctgcctggtaccaaggtactacttcctacgtgacgctctgacgcgggctgggaccaaggcncagtagnnnnnnnnnnnnnnnnnnn

SEQ ID NO: 280440 - DNA, 596 bp, Homo sapiens
  misc_feature: GYAE6OF02HHN42.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagccagacgcctcttacatagtaatggattcaacttatttgaattggtacctgcagagccagggcagtctccacagctctgacttcgttgtttggtctgagtccgggccgtccggggtcctgacgtggttcaggtgcgaggtgatcaggcacgtagtacgtttacgactagaaattcgaaggtaggggtggaggtcgtaggaggtagttggttagggtttattacgtgacgtagtcgacgtaacgttactaaccgttaaaccttccttaaccgttacgttttacgggaccgtaacggggtacccgtaaaggtaccgtagggaacgtaacgtaacgtaaacgtaacgtggttacggacttaccggacgtaccg

SEQ ID NO: 280441 - DNA, 805 bp, Homo sapiens
  misc_feature: GYAE6OF02HIRR9.47.38.D05.1.454.CMB.1.raw
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
tcagagctcacgtacacgaccggtgctcgatttagtatctgatagttgggtttggggaggactcctcagttcaccttctcacaatgaggctccctgctcagctccgtggggctgctaatgctcgtgggtctctggatccgaggtgggattattgtgatgaactcgagtctccactcctccctcgcccgtcacccgtggaacgcgccggctccactctctgcaggtcacgcagtcnccttctacgataagtaagtggtacttacaacgttatttaggaaacgtttcggacctacgtanaaacggtaacggtaccgaaggggtctacgttccaccgtacgacgtcgtccgtagtacgtcgttttggttcggtcctggtacgtccggggtccgttacggggtccctaggtaccgtcggttacgacgggtttacggcgtaacgggttaggtaacctacggaaccgggtaccttaacggttaacggtttaacgttttaccgaacggtttaaacgtaaaacgttcggtaaagggttcgggggtacggtaacgggtacgtaagggtaacgggttaacggtttacggggttttagggttttaacctaggtacgtaacgtacgttaacgggtaacgttaaccgtttaacctaaccgttaaccgttaccgttacgttaccggttacgggacccggtaacggtaaccgtaggttaccggttagggtaaactaacggttaaacccgaaacgggtttaacgtcgggttaccggtactaccgggttaccctaacggtttacgttcccgtttaaaccggg

SEQ ID NO: 280442 - DNA, 506 bp, Homo sapiens
  misc_feature: GYAE6OF02IITQH.47.38.D05.1.454.CMB.1.raw
  modified_base (364)..(364): a, c, t, g, unknown or other
  misc_feature (364)..(364): n is a, c, g, or t
  modified_base (486)..(486): a, c, t, g, unknown or other
  misc_feature (486)..(486): n is a, c, g, or t
  modified_base (489)..(506): a, c, t, g, unknown or other
  misc_feature (489)..(506): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagccagtctgagacctgacgacgacggccgtgtattattgtgcgttagttacggacgtattacgacgttttgattgtcattacccggcgtgtggggcaaagggaccacggtcaccgtctcctcagcctccacaagggcccatccggtcttccccgnggcaccctcctccacgagccacctcgtcggggcacgacgcggccctgggctgcctggcaaggactactcctacgtgacgctctgacggcgggcgtggaccgaaggccgacaacttagactancgnnnnnnnnnnnnnnnnnn

SEQ ID NO: 280443 - DNA, 517 bp, Homo sapiens
  misc_feature: GYAE6OF02GJBO2.47.38.D05.1.454.CMB.1.raw
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (498)..(499): a, c, t, g, unknown or other
  misc_feature (498)..(499): n is a, c, g, or t
  modified_base (501)..(517): a, c, t, g, unknown or other
  misc_feature (501)..(517): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcagttacccggacgtggtgggggcaaagggaccacggtccaccgtctcctcagcctccaccaacgggcccatccggtcctcccccgtcggccacccctcctaccagacgccacctcgtcggggacacgacgccggccgtgggctcgcctggcaaggtcctacttccgtcgtgagccgtcngacggcgggctagggccaagggccncgtagtgntnngnnnnnnnnnnnnnnnnn

SEQ ID NO: 280444 - DNA, 602 bp, Homo sapiens
  misc_feature: GYAE6OF02HDSGW.47.38.D05.1.454.CMB.1.raw
  modified_base (578)..(578): a, c, t, g, unknown or other
  misc_feature (578)..(578): n is a, c, g, or t
  modified_base (580)..(583): a, c, t, g, unknown or other
  misc_feature (580)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(591): a, c, t, g, unknown or other
  misc_feature (589)..(591): n is a, c, g, or t
  modified_base (594)..(602): a, c, t, g, unknown or other
  misc_feature (594)..(602): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgtattacgacgttttgattggtctagttacccggacgttggtggggacgaaaggggaccgacggtccaccgtctcctcacgccctccaaccgaaacgggcccacgttcccggtcctttcccccgtcggcccaccccctcccgtaccaacgacgcctacccgtccgtcgggggccaccgacggcccggcccgtcgggcctcggcccgttgggtaccgaaacgggtccttacccgttcccgttaacggtcggtacgtccgttcttacggacgggccggggtcgtcgggacggtaacgggcccgtacgaagttacggangnnnngngngnnngcnnnnnnnnn

SEQ ID NO: 280445 - DNA, 615 bp, Homo sapiens
  misc_feature: GYAE6OF02G0VJ1.47.38.D05.1.454.CMB.1.raw
  modified_base (262)..(262): a, c, t, g, unknown or other
  misc_feature (262)..(262): n is a, c, g, or t
  modified_base (461)..(461): a, c, t, g, unknown or other
  misc_feature (461)..(461): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcgtggggctggaggtgaagaagccgtggggcctcgagtgaaggtctcctgcaaggcttctggatacngtcttcaccgtactacttatttgctacgtgggtgccggaccgggccccgtgggacgaagggtccttggagtggagtgggacggatcgacgaccctaacgaggtggtggaccaacgaaacgtagtcgacaacgaggtacggtttacgagggtcgagggtcactagtcgacgaggaccacgtcatcgagtacacgacctanacgtgatcgtagacgtcgtacgtcgacggaacgtaccgtaggtaaccgaccgaccggtacggttagttacgttagtttcggtaggttaccgtttaaggtaccggtaacggtagtttaccggtttagtttcggtacggtttcgtacgttacccgg

SEQ ID NO: 280446 - DNA, 670 bp, Homo sapiens
  misc_feature: GYAE6OF02I2RMM.47.38.D05.1.454.CMB.1.raw
  modified_base (637)..(637): a, c, t, g, unknown or other
  misc_feature (637)..(637): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccgaggtgggatagttgtcgatgactcagtctccactcctccctgccctcaccctggagacgcccggcctccatctccgtagccacggttccacgccgaggactccgtcttaacattaggtaatggaattacctaacttgttacgtaagttaggtaccctgacaacgtaacgccgtaacggctacggtcctaccacgacgtccttccgtagtacgttaccgttggttttcggggttacctcggacggtccccggggtccggtttaccccgggggtccctaggtaacgtacggttcgtaggtcggacgtggtcggaacgtacgtacggaccttacgaagttactttaccggctaaacggaatcggaggtgggaggcgtagaggtaaggtgttaagggtttggttaacttcggtagacgtacgtagtacgtacgttacgtaacttaacgtcttacgttacggttcggaccgagggtacaggtcaggtacacgaacgtaaccgngtaggccgagtacgacccgtagtacgtcgttac

SEQ ID NO: 280447 - DNA, 759 bp, Homo sapiens
  misc_feature: GYAE6OF02JKWL3.47.38.D05.1.454.CMB.1.raw
  modified_base (332)..(332): a, c, t, g, unknown or other
  misc_feature (332)..(332): n is a, c, g, or t
  modified_base (571)..(571): a, c, t, g, unknown or other
  misc_feature (571)..(571): n is a, c, g, or t
tcagagctcacgtacacgaccggtgctcgatttagtatctgatagttgggtttgggggagggactcctcagttcaccttctcacaatgaggctccctgctcagctcctggggctgctaatgctctgggtctctggatccaggtggggatattgtgatgactcagtctccactctccctgcccgtcaccccgtggagacggccggcctccatcctcgtcgcacggtctacgccaaggcgcccgttaccttacacttaagtaactggtattaccaacttatttgaattcggtacctgcaacggaagccgagggcacgtcctccacagcctcgtnattcgtaggttttcgggttctaggtacgttccggggaccgtccggggttccctggtaccgtaggttccggtaggtcggacgtaggtcggtactccggacgggtaccacggttacttacgttttaccggcttaacggtaaaacttacggtacgggttaacggggtagggtaacgggtacgtacgggtaagggtacggtttaggggttttacggggttttaaacgtttacgtcggttacgngttacggtaccgtaacggtttaaccgttaaccgttaaaaccgttacccgttaacgtttaaccggttttcccggaacggtaaccggggtaaccggtagttacgtacgggtaacggttaactaaccgggtaaaacgttacggttaacgggtcggtacgttaccggtaccgtaaccgttacgtcggttacg

SEQ ID NO: 280448 - DNA, 415 bp, Homo sapiens
  misc_feature: GYAE6OF02F9EBX.47.38.D05.1.454.CMB.1.raw
  modified_base (402)..(415): a, c, t, g, unknown or other
  misc_feature (402)..(415): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagtacggacgattacgacgttttgattggtcattacccggacgtgtgggacaaagggccacggtcaccgtctcctcacgcctccaccgaacgggccccatccggtccttcccccgtggccacccctcctccaagacgcaccctcgtcgggggccacgagccggccctgggcctgcctggtcaaggcttaccttcctacgtgagctctgacgcgggctggcaggcgcatagnnnnnnnnnnnnnn

SEQ ID NO: 280449 - DNA, 522 bp, Homo sapiens
  misc_feature: GYAE6OF02F4T11.47.38.D05.1.454.CMB.1.raw
  modified_base (365)..(365): a, c, t, g, unknown or other
  misc_feature (365)..(365): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (508)..(509): a, c, t, g, unknown or other
  misc_feature (508)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(522): a, c, t, g, unknown or other
  misc_feature (516)..(522): n is a, c, g, or t
tcagagctcacgtacacgaccggtgctcgatttagtatctgatagttgggtttgggtgcccaagctgctggaggacacggtcaccacgctgcttgagtggatggggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaacgggaccacggtcaccgtctcctcagcctccaccaacggcccatcggtccttccccnggccacccctcctccaacgagccacctcgtcggggcacgcggccggccctgggcctgccgtggtaccaaggtactacttccgtacgtgacgtctctggacgcggggctcgggcgaacgggcgactagtagnancancnngcanncnancgnnnnnnn

SEQ ID NO: 280450 - DNA, 617 bp, Homo sapiens
  misc_feature: GYAE6OF02I0I1C.47.38.D05.1.454.CMB.1.raw
  modified_base (279)..(279): a, c, t, g, unknown or other
  misc_feature (279)..(279): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcgtggggctggaggtgaagagccgtgggcctcgagtgaaggtctcctgcaaggtcttctggatacagcttcgaccgtactactnttgctacgtgggtcgcggacggccctggacgaggtctgagtggagtgggacgatcgacgacctaagaggtggtcgacaacgtaaactagcgacaagaggtacggttacgagggtcgagggtaccaacgtagtacggaacccgagggtaccacgtaccaagtaccacgtaaccacgtaccctaagcgtaggacgcgtagacgtacgtacgtcgacggacgtaccgtacgaccgaccggtacggtaccgttgttaacggttagttcggtacggtacgtttaacggtacggtacgttacgttacggttacgtttaggtacgtttacggtacttaacccggg

SEQ ID NO: 280451 - DNA, 561 bp, Homo sapiens
  misc_feature: GYAE6OF02JZHOJ.47.38.D05.1.454.CMB.1.raw
  modified_base (285)..(285): a, c, t, g, unknown or other
  misc_feature (285)..(285): n is a, c, g, or t
  modified_base (542)..(561): a, c, t, g, unknown or other
  misc_feature (542)..(561): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctggacacacggccgtgtattagttgtgcgttagttacggacgattacgacgttttgattggtntattacccggtacgtgttggggacaaagggaccgacggtcaccgtctcctcacgcctccaccgacgggcccagtcgtccttcccctcggcctacccctcctaccaacgacgaccacctccggtcgggggacctacgacggccggcccgttgggccgtcgccggtcggtaccgaacgggtacctacgttcctaacggttgacgtccgtacgtcggtacggcgggtcgtacggccgtaagggccgccgtaagtacggcnnnnnnnnnnnnnnnnnnnn

SEQ ID NO: 280452 - DNA, 358 bp, Homo sapiens; identical to SEQ ID NO: 280258
  misc_feature: GYAE6OF02G1JO7.47.38.D05.1.454.CMB.1.raw
  modified_base (353)..(358): a, c, t, g, unknown or other
  misc_feature (353)..(358): n is a, c, g, or t

SEQ ID NO: 280453 - DNA, 678 bp, Homo sapiens
  misc_feature: GYAE6OF02FRMSP.47.38.D05.1.454.CMB.1.raw
  modified_base (152)..(152): a, c, t, g, unknown or other
  misc_feature (152)..(152): n is a, c, g, or t
  modified_base (255)..(255): a, c, t, g, unknown or other
  misc_feature (255)..(255): n is a, c, g, or t
tcagagctcacgtacacgaccggtgctcgatttagtatctgatagttgggtttggggaggactcctcagttcaccttctcacaatgaggctcccctgctcagctcctggggctgctaatgctctgggtctctggatccagtggggatattgngatgactcagtctccactctccctgcccgtcacccctggagagccggcctccatcctcctgcaggtctagccagagcctcttacatagtaatggattcaactntttgaattgtacctgcagacgccgaggcagtctccacagctccgtgacttcgtagttttgggttcctggtacgtccggggtcccgttcccgggggtccctaggtaccgtagggttccgagggtcggacgtaggtcggtactcgagggcctaacgtaggttaacgttttaccggacttaaggtaaaactcgtaagggtaacgggtgggacgggtcgtaggaagggtagttgggtttaggggttttacttacgtgtacgtataggtactaacggtttacctaaacgtaaaccgttccttaccgttaacgtttcgggacccgtaagggggaaccctagtaccggtacggtaaacgtaacgtaaacccgtaaaaccgtaccgttaggtacggtcgttaacgaccctaccgttacgttcgttaaccgg

SEQ ID NO: 280454 - DNA, 659 bp, Homo sapiens
  misc_feature: GYAE6OF02G8BBP.47.38.D05.1.454.CMB.1.raw
  modified_base (333)..(333): a, c, t, g, unknown or other
  misc_feature (333)..(333): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcgtggggctggaggtgaagaagccgtggggcctcagtgaaggtctcctgcaaggcttctggatacagcttcaccgactactatttgctactgggtgcggacggccctggacgaagggtcttgagtggagtgggacggntcgacgccctaagagttggtgcaacaaacttgtgactacgaggtaacggtttcgacggggtcaggggtccaaccgagtacggacccgtaaggggaccacggtaccctaagtaccgtagtaaccgacgtaccctaacgagttacgggaacgtccgtaggacgaccgtacgtaccgtaggacgtaaccgtacggacccggtaacgaccggggtccgttaggttaactttacggtttggtacggtttaccggtttaaggttaacccggtaaggttacggtttaaccggtttacggttttacggttacgtttcggttacgttaacccggg

SEQ ID NO: 280455 - DNA, 597 bp, Homo sapiens
  misc_feature: GYAE6OF02FQQI5.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagcctcctgattctgtttgggttctggtacgtccgggtcctccgggggtccctaggaccgtaggttcgtaggtggacgtaggttggactcgacgggcacgagttacgtttacgcgtagaaacgtcgaggttagggtaggaggtctaggagggtagttaggtttgggtttattcgtgctagtagtactaagttacctaacctaaccttccttaactaccgttttacggaccggtacgggaaccgtagcctagggacgtaagtaacgaaacgttacgtaggtggtcgtacgactacctactcgttccg

SEQ ID NO: 280456 - DNA, 859 bp, Homo sapiens
  misc_feature: GYAE6OF02IY0B8.47.38.D05.1.454.CMB.1.raw
  modified_base (491)..(491): a, c, t, g, unknown or other
  misc_feature (491)..(491): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccaggtggggatattgtgatgactcagtctccactcctccctcgcccgtccacccctggacgacgcccggcctccattcctcctcggactacggtccacgccaggacgtccctcctcgccaagaaccttaaagtaggtaaaacttacccgtttaagtttaggactttacgggtaccttgaaccgaaaaaggcccgtaggggacctacggtcctaccaacctaacctccgttagtaacttacttacgtttagggttacctttttaagcccggggtacccgttcccggggtacccttacgggtaaccgttacgggttacctaaccgttcggggtactacggggttaaccggtnttaacccgggaacgtaccgtaacgttaacgttaacgtttttaacgtaaacggtttaacggtaaaaaccgttacgtaaccggacggtaaagggttaacgggtacggggtaacggtacggttacgacgggttaagtaggtccggtttaaggggtttacgttttaactaacggggttatccgttaaggtacgtaaccgttaaacgtaaaccttaaaaccgttaaacccgttttaccgttacccgttaacccggttacccgggtaaccggtaaaccgggtaaccctaaccggtaccgggttaaccgtaacgtttaacgtaacccggtaaccggttaacgttaccgggttggtaaccccgtacggtaaccccg

SEQ ID NO: 280457 - DNA, 599 bp, Homo sapiens
  misc_feature: GYAE6OF02GOF56.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactattgaattggtacctgcagaagccagggcagtctccacagctcctgatctgtttgggtctgacgtcgggcctccggggtcctgacaggttcaggtcgcagtgatcgaggcacgagtactttacgactagaaactcgtaggtagggtggaggcgtaggacggtagttggtttaggggtttattacgtgtctagtggtacgtaacgttacgtaacctaaacctttcccgttaacgttaccgttttacggaccgtaacggggtaccctaggtcgttaacgggaagttaacgtaccgtaaacggtacgttcggtacggtccgtacggaccctacgtacgttacgttaccgg

SEQ ID NO: 280458 - DNA, 359 bp, Homo sapiens
  misc_feature: GYAE6OF02GD5NW.47.38.D05.1.454.CMB.1.raw
  modified_base (354)..(359): a, c, t, g, unknown or other
  misc_feature (354)..(359): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggccaccctcctccaagagcacctctgggggcacagcggccctgggctgcctggtcaaggactacttcctacgtgagctctgagcgggctggcaaggcgcatagnnnnnn

SEQ ID NO: 280459 - DNA, 568 bp, Homo sapiens
  misc_feature: GYAE6OF02HWFMI.47.38.D05.1.454.CMB.1.raw
  modified_base (291)..(291): a, c, t, g, unknown or other
  misc_feature (291)..(291): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccanagctcctgatcgttgtttggttctgagtccgggccgtccggggtccctgactaggttcagtggctaggtggactcgaggcaacgagttatttacgctagaaatcgaggtagggtggaggacgtggaggtagttggtttaggggtttattacgtgctagtgactaacgttctaaactaacttacctaacttacgtttggaccgtagggaccaggtacgtagggaataagtaacgaaacgtaacgtggtcggacgtacgacctaaccgtattacgttcg

SEQ ID NO: 280460 - DNA, 488 bp, Homo sapiens
  misc_feature: GYAE6OF02G6YRT.47.38.D05.1.454.CMB.1.raw
  modified_base (452)..(488): a, c, t, g, unknown or other
  misc_feature (452)..(488): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtggtggggcaaagggaccacggtcaccgtctcctcagcctccaccaagggcccatccggtccttccccctggccacccctcctccaagcgccaccctcgtcggggggcaccgaggcccggccccgtggggtcctcggcccgttgggtaccaacgggtacccttaccgttccctaccggttgacgtcttcgtggacggccgggggtactcgggacgaacgggccgacgtactaggannnnnnnnnnnnnnnnnnnnnnnnnnnnnnnnnnnnn

SEQ ID NO: 280461 - DNA, 401 bp, Homo sapiens
  misc_feature: GYAE6OF02JIMK3.47.38.D05.1.454.CMB.1.raw
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (386)..(401): a, c, t, g, unknown or other
  misc_feature (386)..(401): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtgtggggcaaagggaccacggtcaccgtctcctcagcctccaccaagggcccatcggtcttccccctggccacccctcctccaagngcaccctctggggcacagcgccctgggctgcctggtcaaggctacttcctacgtganctctgagcggctggcaaggcgcatagnnnnnnnnnnnnnnnn

SEQ ID NO: 280462 - DNA, 414 bp, Homo sapiens
  misc_feature: GYAE6OF02HSMP7.47.38.D05.1.454.CMB.1.raw
  modified_base (397)..(414): a, c, t, g, unknown or other
  misc_feature (397)..(414): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggagtgtggggcaaagggccacggtcaccgtctcctcacgcctccaccgaagggccccatccggtccttccccccgtggccacccctcctaccaagcgccaccgtcgtcggggggcacgagccggcccctggggcctgccgtggtaccaagggtacctacttccctacgttgacgtctctggaggcgggctggacaagggcgacacgtagcgnnnnnnnnnnnnnnnnnn

SEQ ID NO: 280463 - DNA, 693 bp, Homo sapiens
  misc_feature: GYAE6OF02IVCD8.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccagtggggatattgtgatgactcagtctccactcctccctgcccgtcacccctggagacgccggcctccatcctcctgcaggtctagccagacgcctcttacatagtaatggattcaacttatttgaattggtacctgacagaagccgagggctagtcctccacgacgcctccgtgacttcgttggttttcggttctgtacgtccgggcccgttccggggtccctgacgtggttcgaggtcggacaggtggactcgacgggactacgtagttacgttttaaccgacgttaagaaaacgttcggtaagggttaggggtacgggtaacgggtcgttagggtaagggttaggtttggggttttaggggttttaacttacggtgtaccgtagttcggtaacgttaacgtttacctaaaccttaaaccgtttaccgttaacgtttacggtttacggacccgggtaacggggtaacctaggtaccggtagggtaacgtaacgtaaaccgtaaacgtacggttcggtacgtaccgtaccgtaccgtacttacgttcgttaaccg

SEQ ID NO: 280464 - DNA, 368 bp, Homo sapiens
  misc_feature: GYAE6OF02JKTQR.47.38.D05.1.454.CMB.1.raw
  modified_base (247)..(247): a, c, t, g, unknown or other
  misc_feature (247)..(247): n is a, c, g, or t
  modified_base (347)..(347): a, c, t, g, unknown or other
  misc_feature (347)..(347): n is a, c, g, or t
  modified_base (355)..(368): a, c, t, g, unknown or other
  misc_feature (355)..(368): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaaggggaccacggtcaccgtctcctcagcctccaccaggccatcggtcttcccccngcaccctcctccagagcacctctgggggcacagcggccctggctgcctggtcaaggactacttcctacgtgagctcctgagccgggctgggcaacgggcncgatacgnnnnnnnnnnnnnn

SEQ ID NO: 280465 - DNA, 437 bp, Homo sapiens
  misc_feature: GYAE6OF02JQKXP.47.38.D05.1.454.CMB.1.raw
  modified_base (217)..(217): a, c, t, g, unknown or other
  misc_feature (217)..(217): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (387)..(387): a, c, t, g, unknown or other
  misc_feature (387)..(387): n is a, c, g, or t
  modified_base (390)..(437): a, c, t, g, unknown or other
  misc_feature (390)..(437): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgtttttgattggtcattacccggacgtgtggggcaaagggaccacggtcaccgtctcctnagcctccaccaagggcccatcggtccttcccccnggtcacccctccnccaagagcacctcgtggggcacagcggcccctgggcctggcctggtcaagggtccctatttccccagtgacgccgttctaggacgccggggcttcgggacctaacgggcgtacgaagttagcngcnnnnnnnnnnnnnnnnnnnnnnnnnnnnnnnnnnnnnnnnnnnnnnnn

SEQ ID NO: 280466 - DNA, 404 bp, Homo sapiens
  misc_feature: GYAE6OF02IIGGD.47.38.D05.1.454.CMB.1.raw
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (396)..(404): a, c, t, g, unknown or other
  misc_feature (396)..(404): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgatttggtcattacccgggacgtggtgggcaaagggccacggtcaccgtctcctcagcctccaccaacgggcccatcggtcttccccctggccacccctcctccaagagcacctcgtcggggcacaggccggccctgggctgccgtggtcgaaggtactacttcctacgtgagctctgngcgggcnggcaaggcnatagnnnnnnnnn

SEQ ID NO: 280467 - DNA, 726 bp, Homo sapiens
  misc_feature: GYAE6OF02GRIQ3.47.38.D05.1.454.CMB.1.raw
  modified_base (223)..(223): a, c, t, g, unknown or other
  misc_feature (223)..(223): n is a, c, g, or t
tcagagctcacgtacacgaccggtgctcgatttagtatctgatagttgggtttgggggaggactcctcagttcaccttctcacaatgaggctccctgctcagctcctggggctgctaatgctctgggtctctggatccagtggggatattgtgatgactcagtcctccactctccctcgcccgtcaccctggagagcccggcctccatctcctgcaggtctanccagacgcctcttacatagtaatggtattacaacgttatttagtaattcggtacctgacagtaacgccgagggacagtcctaccactacgtctcctagtacttcgttggtttggttctggtacggtccgggtcccgttcccgggggtccctaggtaccgtaggttcgtaggttcggacgtaggtacggtatcgaagggtcctaaacggtagttaacgtttacgtacgtaaggtaaaacgtcgggtaaggggttacgggggtaggggtacgtagggtaagggttaggtttaggggttttagggttttaacgtttacggtagacgttacggtacggtacgttaaaccgtttactaaacccgttaaaccgttttacgttaaccgtttacggttttaccggaaccggtaacgggtaaaccgtacggtacggtaggtaacgtactaaaccggtaaacgtacggttaggtcggttacgacgtacctaccgtaacgtttcgtacgttacc

SEQ ID NO: 280468 - DNA, 761 bp, Homo sapiens
  misc_feature: GYAE6OF02JT9XT.47.38.D05.1.454.CMB.1.raw
  modified_base (166)..(166): a, c, t, g, unknown or other
  misc_feature (166)..(166): n is a, c, g, or t
  modified_base (720)..(720): a, c, t, g, unknown or other
  misc_feature (720)..(720): n is a, c, g, or t
  modified_base (726)..(726): a, c, t, g, unknown or other
  misc_feature (726)..(726): n is a, c, g, or t
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcaggtcaccntgaccagggacacgtccatcagtacagcctacatggagtctagagcagtcgtgacgacctgacgacgaccggccgtagttattattgtgtcgttagttacggacgtagttacgtacgttttgattggtctacgttaccggacggtggtggggacgtaaagggaccctacggtaccgaccggttacctccgtaccgtacggtcccctacccggtaacccgaaacgggtcccctaacggtttcccgggtaccccgttttccccccggtccggccccttaaacccccgttccccgttaacccgaaaccgtaccggtaccccgtaccccggttaccgggtcgggggtacccaaccggtaccgggccccggtcccccggtggggtccccgttccggtcccggttacggggtaaccgtaaaccgggtaacccgttttaacccgttccccggttacggttacggttaaccggttcccgttcgggtacgggtaaccgggtaccgggtcggtaaccggggtaccgaaccggggtacggaccctaagttcgccgtagtgaccgngtacgngtgtctctcgcgacgcgtacgacncncacgtagtc

SEQ ID NO: 280469 - DNA, 729 bp, Homo sapiens
  misc_feature: GYAE6OF02HAC5B.47.38.D05.1.454.CMB.1.raw
tcagagctcacgtacacgaccggtgctcgatttagtatctgatagttgggtttgggggaggactcctcagttcaccttctcacaatgaggctccctgctcagctcctggggctgctaatgctctgggtctctggatccaggtggggatattgtgatgactcagtctccactcctccctgccccgtccaccccgtggacgacggcccggcctccactcctcctgacgtaggtctacgccagacgtccttacttaacataagtaagtggtactttactaaacttatttagaactttcggtacctgacgtaaggaacgccgagggctacgtcctaccaacgacgtccttccgtgtactttcgtttgggttttcggttctggtacggtcccgggtccgttcccggggtccctagtaccggtaggttcagggtcgacgtaggtacggatacgaggactaacgtagttacgtttacgactaaagaaacgttcggtaagggtagggtacgggtacgtcggttaagggaggttacggtttgggttttaacgggtttacttacgtcggtactagttacgtaacgttaacgttacctaaacgttaacctttaccgttaaccgtttacggtttaccggaaccgggtaacgggtaaccgtaggtacgtaacggtaacgtaaccgtaaaccgtaacggtacgttacggtacgtacgtaccgtaccgacttaccgtcttaccg

SEQ ID NO: 280470 - DNA, 504 bp, Homo sapiens
  misc_feature: GYAE6OF02FU55K.47.38.D05.1.454.CMB.1.raw
  modified_base (465)..(504): a, c, t, g, unknown or other
  misc_feature (465)..(504): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtgtggggcaaagggccacggtccaccgtctcctcagccctccaccaacgggcccatccggtccttccccctggcacccctcctccaagagccaccctcgtcggggggccacgacggcccggccccgtcggggcctcggcccgttgggtaccgaacgggaccttaccgtttccccgttacgtggacgtcttcctagggaacggccggggccgttgggacccgtaaacgggccgtccgaacttaggctcgnnnnnnnnnnnnnnnnnnnnnnnnnnnnnnnnnnnnnnnn

SEQ ID NO: 280471 - DNA, 404 bp, Homo sapiens
  misc_feature: GYAE6OF02IGLGF.47.38.D05.1.454.CMB.1.raw
  modified_base (389)..(404): a, c, t, g, unknown or other
  misc_feature (389)..(404): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggacaaagggaccacggtcaccgtctcctcagcctcaccaagggcccatccggtcttcccctggccacccctcctccaagcgcacctcgtgggggcacacggcggccctgggctgcctggtcaaggctacttcctagtgagctctgagcggctggcaaggcgcagtagnnnnnnnnnnnnnnnn

SEQ ID NO: 280472 - DNA, 488 bp, Homo sapiens
  misc_feature: GYAE6OF02G9181.47.38.D05.1.454.CMB.1.raw
  modified_base (478)..(488): a, c, t, g, unknown or other
  misc_feature (478)..(488): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctcaccaagggcccatcggtcttccccctggccaccctccctccaagcgcacctctgggggcacgagccggccctggggctggcctggtcaaggactaccgttcctacgtgagctcgtgcgcgggctgggcgaaggcgcataggnnnnnnnnnnn

SEQ ID NO: 280473 - DNA, 500 bp, Homo sapiens
  misc_feature: GYAE6OF02HCEIR.47.38.D05.1.454.CMB.1.raw
  modified_base (366)..(366): a, c, t, g, unknown or other
  misc_feature (366)..(366): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
  modified_base (487)..(500): a, c, t, g, unknown or other
  misc_feature (487)..(500): n is a, c, g, or t
tcagagctcacgtacacgaccggtgctcgatttagtatctgatagttgggtttgggtgcccaagctgctggagggcacggtcaccacgctgcttgagtggatgggacggatcagcccctaacagtggtggcacaaactatgcacagaggtttcagggcagggtcaccatgaccagggacacgtccatcagtacagcctacatggagctgagcagtctgagacctgacgacacggccgtgtattattgtgtcgttagttacggacgagttacgtacgtttgattggtcacttacccggacgtggtggggcaagggccacggtccaccgtctcctcagcctccaccacggccatcggtccttccccgngccaccctcctccaagacgcacctcgtcggggccacgacgcggcccgtgggctcgccgtggtcaacggtacctaccgttcctacgtgagcctctggnggacggtcgnggcgaggcgcatgnnnnnnnnnnnnnn

SEQ ID NO: 280474 - DNA, 922 bp, Homo sapiens
  misc_feature: GYAE6OF02GY41L.47.38.D05.1.454.CMB.1.raw
  modified_base (158)..(158): a, c, t, g, unknown or other
  misc_feature (158)..(158): n is a, c, g, or t
tcagagctcacgtacacgaccggtgctcgatttagtatctgatagttgggtttggggtgatcaggactcctcagttcaccttctcacaatgaggctccctgctcagctccgtggggctgctaatgctcgtgggtctctggatccgagtgggatattgngatgactcagtctccactcctccctgcccgtaccacccgtggacgacggcccgcctcctatcctccgtagacgtacggttcctaacggcccaaggtacgccctttacgttaacagttaaggttaaactggtaacctttaccgaaactttagtttacgaaacgtttcgggtaaccctggccgtaaaggaaacggtccccgaagggggtaccttaaggtcccctaccgtaaaccgtaggtcccctttacccggtaggttacttccggttttacgggttttcggggttaccgttacgggaccggttccccgggggtaccccgttcccggggggttacctacgggtaaaccggtttcggggtttacaacggggttccgggaaccttaggggttaaccggtacttccgggaaacggacccgtaacgttacggttttaacgttttaaccgggaacgttaaacggttaaaacgttcggaaacgggggtttaggggaacccgggtggtaacggttacgggttaacggggttaacggtttttacgggtttaccgggggtttaattttaaccgggtacggttaaccgtaacgttacggtaaaccgtttaacgtaacccgtttaaacccgtttaaaccgtttcccgtttaaaccgtttacgggttaacccgggtaccgggtaacgggtaaccgttaagggtaccgttagggaacccgtaacggttaaccgaaacgtttaccgggtaggttacgtcggttacccggtactaaccgg

SEQ ID NO: 280475 - DNA, 393 bp, Homo sapiens
  misc_feature: GYAE6OF02JBXRL.47.38.D05.1.454.CMB.1.raw
  modified_base (386)..(393): a, c, t, g, unknown or other
  misc_feature (386)..(393): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaaggcccatcggtcttcccctggccaccctcctccagagcacctcgtggggcacagccggccctgggcctgcctggtcaaggctacttctacgtgacgctctgagcgggctggcaaggcgacatagnnnnnnnn

SEQ ID NO: 280476 - DNA, 499 bp, Homo sapiens
  misc_feature: GYAE6OF02H6PGO.47.38.D05.1.454.CMB.1.raw
  modified_base (236)..(236): a, c, t, g, unknown or other
  misc_feature (236)..(236): n is a, c, g, or t
  modified_base (269)..(269): a, c, t, g, unknown or other
  misc_feature (269)..(269): n is a, c, g, or t
  modified_base (452)..(454): a, c, t, g, unknown or other
  misc_feature (452)..(454): n is a, c, g, or t
  modified_base (457)..(457): a, c, t, g, unknown or other
  misc_feature (457)..(457): n is a, c, g, or t
  modified_base (462)..(499): a, c, t, g, unknown or other
  misc_feature (462)..(499): n is a, c, g, or t
tcagagctcacgtacacgaccggtgctcgatttagtatctgataggttggggtttgggtgcccaagctgctggagggcagggtcaccatgaccgagggacacgtccattcaggtacagcccttacgatggagctggagtcagtcgtgagacctgacgacacggaccgtgtacttagttgtgtcgttaggttacggacgtattacggtacgttttgattgggtccagttaccccggngttggtggggacaaaggggccacggtcaccgtntcctcagcctccaccgagggcccatccggtccttccccctggcccaccctcctccaagtacgcacctcgtggggccacgaggccggccctggggcctcgcccgttggtacgaacgggtacttaaccgttccctacggtgacgtcctccgtagcgggcgggcgtggacgaacggcgacaagtgnnngtnagacnnnnnnnnnnnnnnnnnnnnnnnnnnnnnnnnnnnnnn

SEQ ID NO: 280477 - DNA, 395 bp, Homo sapiens
  misc_feature: GYAE6OF02GLB6W.47.38.D05.1.454.CMB.1.raw
  modified_base (362)..(363): a, c, t, g, unknown or other
  misc_feature (362)..(363): n is a, c, g, or t
  modified_base (365)..(367): a, c, t, g, unknown or other
  misc_feature (365)..(367): n is a, c, g, or t
  modified_base (369)..(395): a, c, t, g, unknown or other
  misc_feature (369)..(395): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtccttccccctgccaccctcctccaagacgcacctcgtggggcacagcggccctgggctgcctggtcaaggactacttccgacgtgagctctgacggcgggtctggacgacggcgcgaatagnngnnngnnnnnnnnnnnnnnnnnnnnnnnnnnn

SEQ ID NO: 280478 - DNA, 682 bp, Homo sapiens
  misc_feature: GYAE6OF02H3QW5.47.38.D05.1.454.CMB.1.raw
  modified_base (309)..(309): a, c, t, g, unknown or other
  misc_feature (309)..(309): n is a, c, g, or t
  modified_base (414)..(414): a, c, t, g, unknown or other
  misc_feature (414)..(414): n is a, c, g, or t
  modified_base (518)..(518): a, c, t, g, unknown or other
  misc_feature (518)..(518): n is a, c, g, or t
tcagagctcacgtacacgaccggtgctcgatttagtatctgatagttgggtttgggggaggactcctcagttcaccttctcacaatgaggctccctgctcagctccgtggggctgctaatgctctgggtctctggatccagtggggatattgtgatgactcagtctccactctccctcgcccgtccacccgtggagacggccgcctccatcctcctgcgtacggtactacgccagacgtccttacttacagtagtaatgattactaactattagtaagttgacctgcaagaacgcggaggctacgttcnccaagcgtctccgtagacttcgttggttttacggtcgtagtcgtcccggggtccggtcccggggtccagtacgaggttcgtagtcggtcgagtgtctcggaacgnacttagtacgttttacgactaagtaaaacgttacgaagggtaggggtacgggagtacgtaggtaggttaggtttagggttttagggtttaattccgtagtacgngttacggtaacgtttaacgttaaccgtaaaccttaaaccgtttaccgttaacgtttaaccggtttcggaaccgggaacggttaccaaggtacggttaggaaacggtaacaccgtaaaacggtacgtcggttacgcggtaccgtaccaacgttccgtacgttccg

SEQ ID NO: 280479 - DNA, 712 bp, Homo sapiens
  misc_feature: GYAE6OF02JCISG.47.38.D05.1.454.CMB.1.raw
  modified_base (269)..(269): a, c, t, g, unknown or other
  misc_feature (269)..(269): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
tcagagctcacgtacacgaccggtgctcgatttagtatctgatagttgggtttgggggagcatcacccagcaaccacatctgtcctctagagaactcccctgagagctccgttcctcaccatggactggacctggaggatcctcttcgttggtggcagcacgccacgaggacgtccacctcccgagttgacaacgtggtcgcagtcggtggggctggaggtaggaaagaacggtccggtcggggtcctgtaacggtaggaacggttccnccgttggacgtaacgggtccttcgaggtaactaccgacgtccttaccaaccgtactacttacgtttcgcgtacgtgggtcgccggccggtcccgtaggacgaaggtcgttggacggtggagtcgggacgacgtcgacgtacctaacgnggtcggtgacaacgtaactacgngtacgacggtaacggtcggttcggaacgggtcgtacggggtacaaccgtagtaccgaacggacgggtacnccggtacacgtacgaacgtacgcgtacctaagtacgngacgngacgacgtcacgtcgacgtacgcgtaaccgacggtaccgagggttccgttagtaacgtttcggttacggtaggttaccgggttaaacgtacgggttaaccggttacggtttaccggttagggtttacggttacggttacccgggtcgtttaaacccgggg

SEQ ID NO: 280480 - DNA, 520 bp, Homo sapiens
  misc_feature: GYAE6OF02JPLA6.47.38.D05.1.454.CMB.1.raw
  modified_base (417)..(417): a, c, t, g, unknown or other
  misc_feature (417)..(417): n is a, c, g, or t
  modified_base (469)..(469): a, c, t, g, unknown or other
  misc_feature (469)..(469): n is a, c, g, or t
  modified_base (472)..(475): a, c, t, g, unknown or other
  misc_feature (472)..(475): n is a, c, g, or t
  modified_base (477)..(479): a, c, t, g, unknown or other
  misc_feature (477)..(479): n is a, c, g, or t
  modified_base (481)..(520): a, c, t, g, unknown or other
  misc_feature (481)..(520): n is a, c, g, or t
tcagagctcacgtacacgaccggtgctcgatttagtatctgatagttgggtttgggttgcccaagctgctggagggcgagggtcaccatgaccagggaccacgtccatcagtacagcctaccatggagctgagcagtctgagacctgacgacacggccgtgtacttattgtgcgttaagtacgacgattacggacgttttgattggtcagtttacccggcgttggtgggggacaaagggtaccgaccggtcaccggtcctcctactacgcctcccgacccaagggccccatccggtccttcccccgtgccacccctcctccgaacgagcctaccgtcgttcgggggcacgacgtccggccctgggcccgtaggcccctgggtaccaacggtcctaaccgtttccgtaacgtcgtacnccgttactcgggacgcggggcctacgggcaaccgggtatccgaatagcagtnacnnnngnnncnnnnnnnnnnnnnnnnnnnnnnnnnnnnnnnnnnnnnnnn

SEQ ID NO: 280481 - DNA, 427 bp, Homo sapiens
  misc_feature: GYAE6OF02G4HDU.47.38.D05.1.454.CMB.1.raw
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
  modified_base (387)..(391): a, c, t, g, unknown or other
  misc_feature (387)..(391): n is a, c, g, or t
  modified_base (393)..(393): a, c, t, g, unknown or other
  misc_feature (393)..(393): n is a, c, g, or t
  modified_base (398)..(427): a, c, t, g, unknown or other
  misc_feature (398)..(427): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgtacgttttgattggtcattacccggacgtgtggggcaaagggaccacggtcaccgtctcctcagcctccaccaaggcccattccggtccttccccctggccacccctcctaccaagacncacctcgtgggggccacaggccggcccctggggcctgcccgtggtcaaacggcttaccttccgtaacgttnaaggtcctcgttgacggccgggtctggcgaaaggcgcatagnnnnncnacgtnnnnnnnnnnnnnnnnnnnnnnnnnnnnnn

SEQ ID NO: 280482 - DNA, 760 bp, Homo sapiens
  misc_feature: GYAE6OF02JXTEM.47.38.D05.1.454.CMB.1.raw
  modified_base (418)..(418): a, c, t, g, unknown or other
  misc_feature (418)..(418): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggatccgagtgggattatgtgatgactcagtctccactcgtccctcgccccgtccaccccgtgggacgacggcccggtcctccacttcctccttcgacgtacggtcctacgccacgacgtcctacttacgatagtaatggtacttacaacttatttagacgttacggtacctgacgagaacgcgtaggctacgtctaccgacgtacgcctcgtacggtacttcgtttggtttggttcgtagccggttcccgggccggttacccggtccgtaggtaccgtacggttntaacgggtgacgaggttacggtacgccgaacggtcctaagttaggttacctttacgacgttaaagtaacgttcggtagggttaacggggtgtacggtcgtaggtacggttaggttttagggtttagggttaaacctttcgtacgtaccgttaaggtacgtaacgtttaccgttacccttaaaccgtttacccgtttaaccgtttaaccgttaacggttttcccggggaaccgttaaccgggtactacgggtacggtaacggtaaccgtaacggttaaacgtaacccggttacggtaggttaccgttaccggacctaccgtaccggttacgtttacgtacccg

SEQ ID NO: 280483 - DNA, 465 bp, Homo sapiens
  misc_feature: GYAE6OF02GP7H8.47.38.D05.1.454.CMB.1.raw
  modified_base (448)..(465): a, c, t, g, unknown or other
  misc_feature (448)..(465): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattattgtgtcgttagttacggacgattacgtacgtttttgattggtcagttacccggacgtggtggggacaaagggccacggtccaccgtctcctcacgccctccaaccgaacggcccactccggttcccttcccccgtcggccctacccctcctacccaacgacgccgacctcgtcgggggacacgacggccggtccccgtgggcctcggcccttgggtaccgaaacggtacctaccgttccgtaccgtggacgcctctggacggcgggctggacgaggcgcagtagnnnnnnnnnnnnnnnnnn

SEQ ID NO: 280484 - DNA, 533 bp, Homo sapiens
  misc_feature: GYAE6OF02HZ5EA.47.38.D05.1.454.CMB.1.raw
  modified_base (148)..(148): a, c, t, g, unknown or other
  misc_feature (148)..(148): n is a, c, g, or t
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (485)..(485): a, c, t, g, unknown or other
  misc_feature (485)..(485): n is a, c, g, or t
  modified_base (488)..(491): a, c, t, g, unknown or other
  misc_feature (488)..(491): n is a, c, g, or t
  modified_base (493)..(509): a, c, t, g, unknown or other
  misc_feature (493)..(509): n is a, c, g, or t
  modified_base (511)..(533): a, c, t, g, unknown or other
  misc_feature (511)..(533): n is a, c, g, or t
tcagagctcacgtacacgaccggtgctcgatttagtatctgatagtgggtttgggtgcccagctgctggagggcagggtcaccatgaccaggacacgtccatcagtacagctacatggagctgagctagtctgagacctgacgtaccncggcccggtgtattatgtgcgttagtacggacgtntaccgtgtttgatttcggcattcccgggattggtcggganaaaagggcctacggtcacgtctcccatcggccctnaccggaaagggccccagtccggtccttaccccctggacctacccncctaacccgaagtaccggcaaccgttccggnggggaccctactaccggccgcccgtgggccctttgccctggggttaaccaaggtaaccgttacccttcgaaccgttgggaaactccggtttacaggaccggcgggaacctttgggggactaaacggggtcgaacgtttaagcggtagaccngtnnnncnnnnnnnnnnnnnnnnncnnnnnnnnnnnnnnnnnnnnnnn

SEQ ID NO: 280485 - DNA, 832 bp, Homo sapiens
  misc_feature: GYAE6OF02G1QOZ.47.38.D05.1.454.CMB.1.raw
tcagagctcacgtacacgaccggtgctcgatttagtatctgatagttggggtttgggggagcatcacccagcaaccacatctgtcctctagagaactcccctgagagctccgttcctcaccatggactggacctggaggatcctcttcgttggtcggcagcagccacgaggacgtccacctccctaggttcgactaacgtggtgctaggtcgtggggctggagggtagaaggacggtccggtcggggcctacgaggtagacggtcctcgtggacgaaggtcttcgaggactacgacgtcttaccgaacgtaccttacttagttcgactacggtggggtccgacgggacccgggtccccgtagggaaccggtaacgggttcgttacgggaggtcgggtacgggtacgggggtaaccgtaagtccggtaacggtaccccgtaaacggtacggggttcgggacgggtaccaaaacgtaaacgttacgacggacgtaacggtacgggttacggtttcgggaacggggtaccgtacggggtacctaaccggtagtacccgggtaacccggaacgggtaccgttaacccggtacctaacggtaccggtaccggttaaccgtaaccggtaccgtaaaggttccggtagggtaccttacgtaacgggacggtacgttacggtccgtaaccggaaccggttccgaaaccggaccggtaccgtccgggtacgtttagtttacgttaggtcggttacggtttaaccggtcgggttaaccggttaacgttacgggtttaacgtttcggggtttactacggttttccggaccgtttaaaccgggg

SEQ ID NO: 280486 - DNA, 773 bp, Homo sapiens
  misc_feature: GYAE6OF02J1GWX.47.38.D05.1.454.CMB.1.raw
  modified_base (748)..(748): a, c, t, g, unknown or other
  misc_feature (748)..(748): n is a, c, g, or t
tcagagctcacgtacacgaccggtgctcgatttagtatctgatagttgggtttggggtgatcaggactcctcagttcaccttctcacaatgaggctccctgctcagctcctgggctgctaatgctcgtgggtctctggatccagtgggatattgtgatgactcagtctccactctccctcgcccgtccaccccgtggacgacgccggcctcatcctcctgacacggtctagccagacgtcctctacagtagtatggacttctaaacttattagaatttacggtacctgacgtaaggaaacgtcccgaaggggcctaacggtttccctacccgaacgtacggtcccttacccgttaggtactttcccgtttgggtttttacggggttcttacgggtacggttccccggggtcccgttcccggggggttaccccttaggtaacccgtaggggtttcctaacgggttcgggtacgtacggtttagggacttccgaaacgggccgtaacgttaagtacgttttaacgaaccgtaaggtaaaacgtcggtaaaggtggggtacggacggtcgtaagggtaggtaacggtttgggtttacggggttttaactacggtcggtagtaacgtttgaaccgttaaacggttaccttaaaccgttaaacccgttttaccgtacgtttaaccgttttcgggaccgttacggggtaaccgtcggtaaggtaggtaacgttaactaaccgaaacggttacgngttacggacggttctacccgtaacg

SEQ ID NO: 280487 - DNA, 714 bp, Homo sapiens
  misc_feature: GYAE6OF02ISHH1.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccaggtggggatattgtgatgactcagtctccactctccctcgcccgtcaccctggagacgccgcctccatcctcctgcaggtctacgccagacgtcctacttacataagtaagtggtacttactaacttagtttagtaagtttcggtaacctggacaaggaacgccggaagggcctaggtcctaccacgacggtcctccgtagtacgtttcgttagggttttcgggttctaggtacgtccggggtcccggttccccggggttccctaggacgtaggttcaggtggactaggtcgatcgaggcacgtaagttacgtttacgacgtaagaaacgtacggtaagggttaggggtagggtacggtacggttacgggagggttaggtttaggggttttaacggggttttactttacgtgtacgtagtacgtagtaacgtttacaaaccgttaaccgtttactaaccgttttacggtttacggaaccggtaacgggtaaccgtagtaccggtagggtacgtaacgtaaccggtaaaacgtacggttaggtcggtacgtccgaccgtacgtacgttacgttaccg

SEQ ID NO: 280488 - DNA, 705 bp, Homo sapiens
  misc_feature: GYAE6OF02GHYA9.47.38.D05.1.454.CMB.1.raw
  modified_base (537)..(537): a, c, t, g, unknown or other
  misc_feature (537)..(537): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagccgtggggcctcgaggtgaaggtcctccgtgacgaaggtcttcgtaggactacgagtccttacgacccgtacttacttatttcgcctacgttggggtcgccggaccgggtccccgtaggaccgaagggtcttaggacggtgggacgtcggggaacggtatcgacgacccgtaagtggtcggtcggacaacgtaaactgtacgacgaacgtaggttacggtttacggaggggtacgaggggtaccaacgtacgtacgacgaacgggacctaaccgtaccagtaccgaacgtacgaaccgtccgtaacgtaggtcgaacgtcgngaacgtccgtaggtcgtacggacggtaaccgttacgaaccggaccgtaccgggttcgtacggtttagttacgtttcgggtaacggttacggttttaacggtaccgggttaagtaaccggttttaccggttaacgttttggtacggttttacggtacgttaacccgggg

SEQ ID NO: 280489 - DNA, 511 bp, Homo sapiens
  misc_feature: GYAE6OF02H0T8J.47.38.D05.1.454.CMB.1.raw
  modified_base (472)..(511): a, c, t, g, unknown or other
  misc_feature (472)..(511): n is a, c, g, or t
tcagagctcacgtacacgaccggtgctcgatttagtatctgatagttgggtttgggtgcccaagctgctggagggcacggtcaccatgaccagggacacgtccatcagtacagcctacatggagctgagcagtctgagacctgacgacacggccgtgtattattgtgcgttagttacggacgattacgacgttttgattggtcattaccccggagttgtgggcaaagggaccacggtcaccgtctcctcagcctaccaccaagggtcccaatccggtacttccccccgtggcctaacccctcctaccgaacgacgcctaaccgtcccggtcgggaccaacgtacggcccggtccggtcgggccgttaccggccgttcggtaacgaaacggtaccgtttaaccttaccggtacggtacggtacgtcccgtagtcggacgggcggtcgtacggacggaacggtcgagtacagcnnnnnnnnnnnnnnnnnnnnnnnnnnnnnnnnnnnnnnnn

SEQ ID NO: 280490 - DNA, 713 bp, Homo sapiens
  misc_feature: GYAE6OF02FTUY1.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctgggtctctggatccgaggtggggatattgtgatgactcagtctccactctccctcgcccgtcaccccgtggacgacgccggcctccatcctcctgcacggtctacgccagacgtccttctacaattaagtaactggtaacttacaacttagtttagaagttcggtacctcgacgaacggaacgccggagggaccagtccgtaccgacgacgtcctccgtgtactcgttggttttcgggttctaggtacgtcccgggtacccggttcccgggtccctaggaccgtagggttacgtggtacggcgtacggtcgaactcgacggtactacgtaacgttacgttttacgactaacggtaaacgtacggtaagggttagggtacgggtacgggtacgtagggtaggttaggttacgggtttagggtttacgtacgtacgtacgtacgttacgtacgttaacgtttacgtaaccttaacctttccgttaacgttacggtttacggaaccgtacggggtacctacgtacggtacggtaactaccggtaacgaacggttacggtacggtacgcgtaccacgtaccgtcttagttaccg

SEQ ID NO: 280491 - DNA, 678 bp, Homo sapiens
  misc_feature: GYAE6OF02HVWOO.47.38.D05.1.454.CMB.1.raw
  modified_base (234)..(234): a, c, t, g, unknown or other
  misc_feature (234)..(234): n is a, c, g, or t
tcagagctcacgtacacgaccggtgctcgatttagtatctgatagttgggtttggggaggactcctcagttcaccttctcacaatgaggctcctgctcagctcctggggctgctaatgctctggtctctggatccagtgggatattgtgatgactcagtctccagtctccctgcccgtcatcgttgagacgcgctccatctcctgccaggtctacggcctaagacgcttctaanatagtaatggattcaacttattgaacttggtacctgacagaaagcccaagggctagtcttaccactaggccttactgtaatcctagtttcgggttctcgtagtcgggtcctcccggggtcctggacctaggtttaccaagtcggctaaggtagggtacttacgaacggcaacgtacgtaagtttttacccgagtacggtaaaactcgaaaggttacgggggtcggtaaggtcgttacgggaaggttacgtttaggggtttcgggggttttaaattacgggtcgtaaccgttgttacgtacgtaagtttacctaaacgtaaaccctttccgttaactcgttttaaccggacgttaacggggaccgtaaacggacgttagggaacgttaaccgtaccgtaaaccgtaaacttcgggtcggtacgtaccggtactacccgtatcccg

SEQ ID NO: 280492 - DNA, 824 bp, Homo sapiens
  misc_feature: GYAE6OF02JDQ56.47.38.D05.1.454.CMB.1.raw
tcagagctcacgtacacgaccggtgctcgatttagtatctgatagttgggtttggggaggactcctcagttcaccttctcacaatgaggctcctgctcagctccgtgggctgctaatgctcgtgggtctctggatccgaggtggggatagttggtgatagactcgacgttctccacttcctccctcgtcccgtccacccgtggacgacgcccggtcctccactcctcgtgaccgtacggtctacgaccagccgtccttacttaacgaattaacgtaacgttcggtaacttaccgtaaatttacgtttaagtaacggtttcgtaaccttgaacgaaggtaaccgcggaacgggtacctagtaccgtaccacgcgtcctccgtagtacgtttccgtttagggtttcggtactcggtacggtccgggtccccggtcccggggtactacggtacgttcggtacgtagggtacggtacgtagggttacgtacgtaccgtacgggaaccttacgtaacgtttaccgtttaaccgacgttaaaagtaacggtacggtaacggggttaggggtaacgggtagggttacgggttagggttaacgggtttaggggttacggggtttttaagttacggtacgttaagtacggtaaggttaccgttaaacgtttaaccgttaacccggttaacctttaaccgttacgttaccggtttacggtaccggtaaccggtaaccggtaacgttaccggaacgtagggttaacctaaacggtaaaccttaacggtcgttacggaccgttagtaacccgacggtacgttacttacgggttacc

SEQ ID NO: 280493 - DNA, 788 bp, Homo sapiens
  misc_feature: GYAE6OF02HXY3H.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctactgggtctctggatccaggtggggatattgtgatgactcgagtctccactctccctgcccgtcacccctggacgacgtccggcctccatctccctagcaggtctagccagacgcctatacagtaggtaactggattctaacttattacgaatttggtaccttgacgaaggaacggcccgaaggggacctaacggtccttacccaacgtaacggtccttacccgtagtacttcgtttacggttttacgggtactttttaaacggccggggtcccgttccccgggggtacccgtagtacgtaccggttctaacgtcggatacggtagacgtacgtaggccaacgtagtaacttttaccaaggttacgtaaaatccgtaaggtacgtaacggtaagggtagggaaccggtacgttagggaacgtacgttcgacgttacgggttaacgtttaagttaccggttagaccctaaggtacgtaaccgtaaaacggtaaacccgttaaaaacctaacccgttttaacccttttaccccgggaacccgtttaccggggaccgggttaaaacggtacccggtaaaacgggtacccgtagggtaaaccgttaacggttaaccggtaaccggtaaccggttaggttacccgggtacttacccggaccttaaaccccgg

SEQ ID NO: 280494 - DNA, 489 bp, Homo sapiens
  misc_feature: GYAE6OF02GLA8H.47.38.D05.1.454.CMB.1.raw
  modified_base (467)..(467): a, c, t, g, unknown or other
  misc_feature (467)..(467): n is a, c, g, or t
  modified_base (473)..(489): a, c, t, g, unknown or other
  misc_feature (473)..(489): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattaccggacgtgtgggcaaagggaccacggtcaccgtctcctcacgcctccaccaagggcccatcggtcttccccctggccaccctcctccaacgagccacctctggaggcacagccggccctgggctgcctggtcaaggctacttcctacgtcgagtctctggcgcgggctgggcaaggcncagtgnnnnnnnnnnnnnnnnn

SEQ ID NO: 280495 - DNA, 900 bp, Homo sapiens
  misc_feature: GYAE6OF02JM6TY.47.38.D05.1.454.CMB.1.raw
  modified_base (254)..(254): a, c, t, g, unknown or other
  misc_feature (254)..(254): n is a, c, g, or t
tcagagctcacgtacacgaccggtgctcgatttagtatctgatagttgggtttgggtgatcaggactcctcagttcaccttctcacaatgaggctccctgctcagctcctgggctgctaatgctctgggtctctggatccgaggtgggatattgtgatgactcgagtctccactctccctgcccgtcaccccgtggacgacgcccggcctccagtctccgtgcaggtcctagccagacgcctctacatagtaanggtattctaacttattgaagttcggtacctgacgtagaacgcgtaggctagtcctacgacgacgtcctcctagtacgttcgtttggttttcggggttactcggtaccggttccgggtccccggttcccgggggtacctggaaccgtaggttacgtaggtcgcgttaggtacggtactaccgaggaccgtacgtagtttaccgttttacggaacgttaacgtaaaacgttcggtaaacggggttagggtacgggtaacggtcggtaacgggttaacgggttaagggtttaaggggttttacgggtttttaaaccgttacggtagttaccggttaacggttaccggttaaaccggggtttaaaccgttttaacccggtttaaaaccgtttaaacccgtttttaaacccccggttttaaacgggttttaccccgggtttttaaccggggggaaccccggggttaaacccgggggtaacccgttaaacccggggggttaccggtttaaacccgggggtaaaccgggtttaaaacccgggtttaaaccccggtttaaaaaaacccggggttacccggggtttttccgggggttaaaaccccggggttacccggtttttaaaccccggggaacccgttttaaacccccgggg

SEQ ID NO: 280496 - DNA, 375 bp, Homo sapiens
  misc_feature: GYAE6OF02FSQFY.47.38.D05.1.454.CMB.1.raw
  modified_base (361)..(375): a, c, t, g, unknown or other
  misc_feature (361)..(375): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcataggnnnnnnnnnnnnnnn

SEQ ID NO: 280497 - DNA, 391 bp, Homo sapiens
  misc_feature: GYAE6OF02FOUAW.47.38.D05.1.454.CMB.1.raw
  modified_base (385)..(391): a, c, t, g, unknown or other
  misc_feature (385)..(391): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggccacggtcaccgtctcctcagcctccaccaaggcccatcggtcttccccctggcaccctcctccaagagcacctctgggggcacagcggccctgggctgcctggtcaaggactactcctacgtgagctctgacgcgggctggcaaggcgacatagnnnnnnn

SEQ ID NO: 280498 - DNA, 837 bp, Homo sapiens
  misc_feature: GYAE6OF02JKIYK.47.38.D05.1.454.CMB.1.raw
  modified_base (217)..(217): a, c, t, g, unknown or other
  misc_feature (217)..(217): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctctggatccaggtgggatattgtgatgactcagtctccagtctcccgtcgcccgtcagttcgttggagacgcccggcctccattctccngacgtaggtctacgccgagacgtccttcttaacgattaacgtaattacggtatttaccaaacttagttttagtaagtttcggtacctaggaccgtaacggtaacgcccggaagggacgtaacggttcctacccgaacgtacggtccttaccgtagttacgttcggtttcggttttcggggttaccttggtaccgggttcccgggtccccggttacccggggttccgtacggtaacgttacgggttaccgtaggttcgggacctacgggtagtaaacccggtcggtaacgggacctaacggttacggtttaacgttttaccggtaacgtaaaaggttaaaccgttacgggtaacgggttaggggttacggggtaaccgggttacggtaagggtacgggttaaggttttcggggttttaacggggttttacgttaacgtacggtacgttacggttacgtaacggtttaaccttacgtttaaacctaaccgttttaccgtaacgtttcggttaccggaaccgggttacgggaaccgttacgggtacggtaacgggtaactaacgttaacggtaaacgtaaccggtgggttaccgaccggtactacccggttctacgttaccgg

SEQ ID NO: 280499 - DNA, 480 bp, Homo sapiens
  misc_feature: GYAE6OF02HDHD1.47.38.D05.1.454.CMB.1.raw
  modified_base (432)..(480): a, c, t, g, unknown or other
  misc_feature (432)..(480): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggccacgggtcaccgtctccctcacgccctccaccaagggccccatccggtccttcccccgtggccacccctcctccaagagccacctcgtcgggggcacgagccggccctgggctcgccgtggtcaaggtacctacttcctaagttgtaactacttcgtggacggccgggtcgtcgggacgtaaacgggcgaacctagtcggacnnnnnnnnnnnnnnnnnnnnnnnnnnnnnnnnnnnnnnnnnnnnnnnnn

SEQ ID NO: 280500 - DNA, 647 bp, Homo sapiens
  misc_feature: GYAE6OF02I5SAC.47.38.D05.1.454.CMB.1.raw
  modified_base (393)..(393): a, c, t, g, unknown or other
  misc_feature (393)..(393): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactcctccctgcccgtccaccccgtggagacgccggcctccatcctcctgcaggtctacgccagacgcctcttacatagtaagtggtattacaacttagtttagaagttcggtacctgacaagaacgccgtagggcacgtctccacgcgcctcctgtatcgttgtttggttctgtacgtccgggtcccgtccgggggtcctggacgtaggttcgaggtcggngtaggtggactcgaggcacgtagtacgttttacgctaaagtaaagtcgaagggttagggtacgggaggtcggttaggaagggttaggttagggttttaggggttttacttacgtgtacgtagtacgtacgtaagttacctaaaccgttaacctttaccgtaacgttacgtttacggaccggtaacgggtaaccgtaaggtacggtagggtaacgtaacgtaccgaaacgtacggtacgtcggacctgacctacg

SEQ ID NO: 280501 - DNA, 661 bp, Homo sapiens
  misc_feature: GYAE6OF02JC36J.47.38.D05.1.454.CMB.1.raw
  modified_base (121)..(121): a, c, t, g, unknown or other
  misc_feature (121)..(121): n is a, c, g, or t
  modified_base (127)..(127): a, c, t, g, unknown or other
  misc_feature (127)..(127): n is a, c, g, or t
  modified_base (142)..(142): a, c, t, g, unknown or other
  misc_feature (142)..(142): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (296)..(296): a, c, t, g, unknown or other
  misc_feature (296)..(296): n is a, c, g, or t
  modified_base (614)..(615): a, c, t, g, unknown or other
  misc_feature (614)..(615): n is a, c, g, or t
  modified_base (621)..(621): a, c, t, g, unknown or other
  misc_feature (621)..(621): n is a, c, g, or t
  modified_base (627)..(627): a, c, t, g, unknown or other
  misc_feature (627)..(627): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
tcagagctcacgtacacgaccggtgctcgatttagtatctgatagttgggtttgggtgcccaagctgctggagggcacggtcaccacgctgcttgagtggatgggacggatcagaccctanagtggngcacaaactatgcanagaggtttcagggcaggtcaccatgaccagggacacgtccatcagtacatcctaacatggagtccagngcagtcctaggactaaccngaacgacgaccggtacgtgtaattacgttgtgtacgttagttaacggacgtattaacgtacgtttanaattggtctaacgttccggagtcggtggacgtaaaggaccaacggtccaacgtctaccctacgtacgaccgtaccacgaacgggtccctaagtccgggtacctttcccccggtaggaccctaccccttaccgtacccgaaagaccgtaccgtaacccgttccggtacgggggacaacccggaaccggacccggccccggtttacggggcccttcggcccgttacggacgtaaacggaccttaaccgttacgttaccgtagacggtactcggtagacgccggacgcgggaacgacgtacgccgtaaagtgacggttaanncacganagcganacagtagtananactacgactactacgtacgtcg

SEQ ID NO: 280502 - DNA, 358 bp, Homo sapiens
  misc_feature: GYAE6OF02HXW8M.47.38.D05.1.454.CMB.1.raw
  modified_base (354)..(358): a, c, t, g, unknown or other
  misc_feature (354)..(358): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgccctggtcaaggactacttcctacgtgagctctgagcgggctggcaaggcgcatagnnnnn

SEQ ID NO: 280503 - DNA, 655 bp, Homo sapiens
  misc_feature: GYAE6OF02F3X9Z.47.38.D05.1.454.CMB.1.raw
  modified_base (206)..(206): a, c, t, g, unknown or other
  misc_feature (206)..(206): n is a, c, g, or t
  modified_base (500)..(500): a, c, t, g, unknown or other
  misc_feature (500)..(500): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (629)..(629): a, c, t, g, unknown or other
  misc_feature (629)..(629): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (652)..(653): a, c, t, g, unknown or other
  misc_feature (652)..(653): n is a, c, g, or t
  modified_base (655)..(655): a, c, t, g, unknown or other
  misc_feature (655)..(655): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagaggtttcagggcagggtcaccatgaccagggacacgtccatcagtacagcctacatgganctgagcagtctgacgacctgacgacacgggccgtagttattattgtgtacgttagttacggacgagttaacgtacgttttgattacggtctaacgttacccggagttggtaggggacgtaaaacgggaccgtacggtcgaaccgtcctcctccacgccgtccaaccgaacgggaccctacgtccggttacctcccccgtcggccgacccctacccgtacctaaacgacgaccctacccgtacggtcgggggactacggaccgcccgggtaccgttacgggaacgcggtacccgngggtttaaccggaaacgggtaacccttaacccgtttacccgtaaccggttcgaacgggttccttacgtcggaacgggtccgggccgtttaggaccgaaacgggccgacgtaaagtagngngngtacgangcncnagacgagcgacgncntcnngn

SEQ ID NO: 280504 - DNA, 413 bp, Homo sapiens
  misc_feature: GYAE6OF02G10JU.47.38.D05.1.454.CMB.1.raw
  modified_base (402)..(413): a, c, t, g, unknown or other
  misc_feature (402)..(413): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgatttggtcattacccggacgtgtggggcaaagggccacggtcaccgtctcctcagccctccaccaaggcccatccggtcttccccctggcacccctcctccaagacgcacctcgtgggggcacgagcggccctggggcctgccgtggtcaacggacttaccttcctacgtgacgcctcgtgaggcgggctggcgaggcgcatagnnnnnnnnnnnn

SEQ ID NO: 280505 - DNA, 575 bp, Homo sapiens
  misc_feature: GYAE6OF02GY4QL.47.38.D05.1.454.CMB.1.raw
  modified_base (285)..(285): a, c, t, g, unknown or other
  misc_feature (285)..(285): n is a, c, g, or t
  modified_base (350)..(350): a, c, t, g, unknown or other
  misc_feature (350)..(350): n is a, c, g, or t
  modified_base (555)..(575): a, c, t, g, unknown or other
  misc_feature (555)..(575): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagaggtttcagggcagggtcaccatgaccagggacacgtccatcagtacagcctacatggagctagagcagtctgacgacctgacgacgacggtccgtgtattagttgtgtacgttagtacggacgtattacgtacgtttnagttgtctacgttacccggaggtggtaggggacgaaacgggccgacggtccaccgtcctcctacncgcctaccgaccgacgggcccagttcccggtcccttccccgtcggtacctacccctcctaccgaacgacgccctaccgtcggtcggggcacggaccgcccgggccgtgggcctcgccggtaggtaccgaacgtaccgttaccgttccgtacggtcgacgtctcgtaggacggtccgggcgtcggacgtaacgggcgatacgtcgnnnnnnnnnnnnnnnnnnnnn

SEQ ID NO: 280506 - DNA, 611 bp, Homo sapiens
  misc_feature: GYAE6OF02FHHT8.47.38.D05.1.454.CMB.1.raw
tcagagctcacgtacacgaccggtgctcgatttagtatctgatagttgggtttggggtgatcaggactcctcagttcaccttctcacaatgaggctccctgctcagctcctgggctgctaatgctctgggtctctggatccagtgggatattgtgatgactcagtctccactctccctgcccgtcacccctggagagccggcctccatctcctgcaggtctagccagagcctcttacatagtaatggattcaactattttgaattggtatctgcagaagccagggcagtctccacagcctcctgactcttgtttggtctgacgtcgggccctccggggtcctgactaggttcagtgctaggtggactcgaggcacagtacgtttacgctagaaatcgtaggtagggtaggaggcgtaggaggtagttgggttttaggggttttatttacgtcgtacgtagtacgtacgttaacgtttacctaaccttaaaccgtttaccctaaccgtttaccgtttttacgggaccggtaacggggtaacccgtaacggtaccgtagggaacgtacgtaccgaaaccggtaacgttacggtacggtaccgtcggtaacccg

SEQ ID NO: 280507 - DNA, 760 bp, Homo sapiens
  misc_feature: GYAE6OF02JW80O.47.38.D05.1.454.CMB.1.raw
  modified_base (449)..(449): a, c, t, g, unknown or other
  misc_feature (449)..(449): n is a, c, g, or t
tcagagctcacgtacacgaccggtgctcgatttagtatctgatagttgggtttggggaggactcctcagttcaccttctcacaatgaggctccctgctcagctccgtggggctgctaatgctctgggtctctggactccaggtgggatattgtgatgactcgagttctaccactctccctcgacccgttcaccctggagccggcccgtcctccacttcctcctgctacggtcagccgtagctccttactacatagtaactggtacttacctaacttagtttagaagttcggtaacctgacgtaacggtacgccgtaagggctaacgtcctacgaacacgtcctcgtagtcttggtttgggtttggtacctaggtaccgtccgggtacccgttccgggtacccgtagtaacggtgttaccgaggtttcggacgttacggtgggttaaccncggacggttaacctacggtttaacgtttacgttaaccgtaggtaaacgttaacgtcgggtaagggtaagggtacggtacggtacgtagggttagttgggtttaaacgggttttaggtttaacgttccgtacgttacgtacgtacggttaacgttaacgtttacccgttaaacgttaccgtttaaaccgttaccgttaacgttaccgggaaaccgtaacgtaacggacgttcggtaacggacgttaaacctaacgggttaaccgtaacgtgggtaacctggtaacccgtaccgtacgttcgttaccgttacg

SEQ ID NO: 280508 - DNA, 748 bp, Homo sapiens
  misc_feature: GYAE6OF02HB8DK.47.38.D05.1.454.CMB.1.raw
  modified_base (507)..(507): a, c, t, g, unknown or other
  misc_feature (507)..(507): n is a, c, g, or t
  modified_base (584)..(584): a, c, t, g, unknown or other
  misc_feature (584)..(584): n is a, c, g, or t
tcagagctcacgtacacgaccggtgctcgatttagtatctgatagttgggtttggggaggactcctcagttcaccttctcacaatgagctcctgctcagctccgtggggctcctgctgctctcggttccaggtcgccgaggtgtcgactactccagtactcgacctacgtcctccacttccctccgtcgttctcgctacgttcgtaggtaacggacgtaacgtacggtacgtaccaactacttaccgtacggttccgggccgggacgtacggtcggtacgggtcgttacgtaactagttcgttcgttcggtcgttcgttcacgtacaacgtaccgtaacggaacggacccgtaccgtacgccgtacgtagtacgtacgtggtacgtacgtaacctacgtaaccgttacgtaacggtaacggtacgggtaccgttacctacggttaccggtacggtaccgacggcggtaacggtaggtacggtaggtacgtaacgtacgtccgttacncgttactactacgtacgcgtacgtccgcgtcgaccgcgttacgaagttctccgttacgaccgtttactaacgtttcncctttaccgcttaacggtacttacggtacgtacgttcccttaccgttaccgggttaccgtacgtaccggaaagtttacggaacggttacgtaacggtaacaaccggttacggtacgtcgtccggtataccgtacgtcgttacccttggttacccttacgtaccg

SEQ ID NO: 280509 - DNA, 494 bp, Homo sapiens
  misc_feature: GYAE6OF02FKKE5.47.38.D05.1.454.CMB.1.raw
  modified_base (475)..(477): a, c, t, g, unknown or other
  misc_feature (475)..(477): n is a, c, g, or t
  modified_base (479)..(494): a, c, t, g, unknown or other
  misc_feature (479)..(494): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgatttacgacgttttgattggtcattacccggacgtgtgggggcaaagggaccacggtcaccggtctcctcagcctccaccaagggcccatcggtcttccccctggccaccctcctcccaagacgcacctctgggggcacagcggccctggggctgcctggtcaaggctacttcctacgtgagctctgagcggctgggcaaggcgcgagtagnnngnnnnnnnnnnnnnnnn

SEQ ID NO: 280510 - DNA, 453 bp, Homo sapiens
  misc_feature: GYAE6OF02I47GY.47.38.D05.1.454.CMB.1.raw
  modified_base (425)..(425): a, c, t, g, unknown or other
  misc_feature (425)..(425): n is a, c, g, or t
  modified_base (427)..(453): a, c, t, g, unknown or other
  misc_feature (427)..(453): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgattggtcattacccggacgtgtggggcaaagggccacggtcaccgtctcctcagccctccaccaagggcccatccggtccttccccctggcctacccctcctccaagacgccacctcgtgggggccacgacgccggccctagggcctgcccgtggtaccaacggtaccttaccttccctacggtgacgtccgttcgtgacggcgggctggaccgaagggcacagtagntnnnnnnnnnnnnnnnnnnnnnnnnnnn

SEQ ID NO: 280511 - DNA, 399 bp, Homo sapiens
  misc_feature: GYAE6OF02GB4WB.47.38.D05.1.454.CMB.1.raw
  modified_base (384)..(399): a, c, t, g, unknown or other
  misc_feature (384)..(399): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagccctccaccaacgggcccatccggtccttccccccgtggccacccctcctccaagacgccacctctgggggccacgacgccgccccgtggcgtgccgtggtacgaagacttacttccgtacgtgacgctctgaggcggcgtggacaacggcacgatagnnnnnnnnnnnnnnnn

SEQ ID NO: 280512 - DNA, 480 bp, Homo sapiens
  misc_feature: GYAE6OF02H4XQM.47.38.D05.1.454.CMB.1.raw
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (448)..(480): a, c, t, g, unknown or other
  misc_feature (448)..(480): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggagtgtggggcaaagggccacggtcaccgtctcctcagccctccaccaagggcccatccggtcctttcccccccgtggccctacccctccctacccaagacgccaccttccggtgggggaccacgacggccgggcccgtgggcctcgcccgttggtacaaacgggaccttaccgttaccctacggttgacgtccttagtcgggaggccgggctcgggacgaagggccncgatgncgnnnnnnnnnnnnnnnnnnnnnnnnnnnnnnnnn

SEQ ID NO: 280513 - DNA, 445 bp, Homo sapiens
  misc_feature: GYAE6OF02H6G8L.47.38.D05.1.454.CMB.1.raw
  modified_base (338)..(338): a, c, t, g, unknown or other
  misc_feature (338)..(338): n is a, c, g, or t
  modified_base (421)..(445): a, c, t, g, unknown or other
  misc_feature (421)..(445): n is a, c, g, or t
tcagagctcacgtacacgaccggtgctcgatttagtatctgatagttggggtttggggtgcccaagctgctggagggcagggtcaccatgaccagggacacgtccatcagtacagcctacatggagctgagcagtctgagacctgacgacacggccgtgtattattgtgcgttagttacggacgtattacgagttttgatttggtcaattacccggagtgtggggacaaagggacccaggtcaccgttctcctcagccctcaccgaagggcccatccggtcttccccctggccacccctcctccaagcgccaccgtcgtggggccacacgccggcccngggctgccgtggtcgaaggacttaacgtcctacggtgagctcgtagacggcgggtctggacgaacgggtcactaacgtaggcnnnnnnnnnnnnnnnnnnnnnnnnn

SEQ ID NO: 280514 - DNA, 180 bp, Homo sapiens
  misc_feature: GYAE6OF02HR6S9.47.38.D05.1.454.CMB.1.raw
  modified_base (170)..(180): a, c, t, g, unknown or other
  misc_feature (170)..(180): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgtacgtttnnnnnnnnnnn

SEQ ID NO: 280515 - DNA, 725 bp, Homo sapiens
  misc_feature: GYAE6OF02IARFF.47.38.D05.1.454.CMB.1.raw
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (621)..(621): a, c, t, g, unknown or other
  misc_feature (621)..(621): n is a, c, g, or t
  modified_base (627)..(627): a, c, t, g, unknown or other
  misc_feature (627)..(627): n is a, c, g, or t
  modified_base (633)..(634): a, c, t, g, unknown or other
  misc_feature (633)..(634): n is a, c, g, or t
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagcctgagcagtctgagacctgacgacacggcctgtatttattgtgcgttaagttacggacgattacgagtttttgatttggtcagttacccggacgtggtgggactaaagggccacgggtaccaaccgtctcctacgacgtcccgtaccaaccggaacggggccccaacgtttacccgggtttcccttttaccccccccggtacgggtcccctaaaccccccgttccccttaaccccgaaaggtacggccccgtaaccccgttacccgggttggggggaccctaaccggacgggtcccggggtcccccgttggggtcccgtcggccccgttcggggttaccaaaacgggaccttttaaccgttaccccgttagttaaccgttaccttaaccgttacgttggggtaaccgggccggggttaccgtagggaccccgggtaaaacggggtccccaacggttaaacgtacggacgtcgagactancgngnganacgnacgancgtcanatgcgnngacacacgacagtacngacganagcncgacgtcctactacacgacgtacgacgtcaccacgtccgacgacgacgtacctgacgacgacgtc

SEQ ID NO: 280516 - DNA, 408 bp, Homo sapiens
  misc_feature: GYAE6OF02HZC50.47.38.D05.1.454.CMB.1.raw
  modified_base (365)..(365): a, c, t, g, unknown or other
  misc_feature (365)..(365): n is a, c, g, or t
  modified_base (368)..(408): a, c, t, g, unknown or other
  misc_feature (368)..(408): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgtacgttttgattggtcattacccggacgtgtggggcaaagggaccacggtcaccggtctcctcagcctcaccaagggccatcggtcttcccctggcaccctcctcaagacgcacctcgtcggggcacagcggccctggctgcctggtcaagactaccttacctacgtgagctcgtgaggcggctcggcagggtcgcactagancannnnnnnnnnnnnnnnnnnnnnnnnnnnnnnnnnnnnnnnn

SEQ ID NO: 280517 - DNA, 550 bp, Homo sapiens
  misc_feature: GYAE6OF02FZLDS.47.38.D05.1.454.CMB.1.raw
  modified_base (380)..(380): a, c, t, g, unknown or other
  misc_feature (380)..(380): n is a, c, g, or t
  modified_base (525)..(525): a, c, t, g, unknown or other
  misc_feature (525)..(525): n is a, c, g, or t
  modified_base (530)..(532): a, c, t, g, unknown or other
  misc_feature (530)..(532): n is a, c, g, or t
  modified_base (535)..(535): a, c, t, g, unknown or other
  misc_feature (535)..(535): n is a, c, g, or t
  modified_base (537)..(539): a, c, t, g, unknown or other
  misc_feature (537)..(539): n is a, c, g, or t
  modified_base (542)..(545): a, c, t, g, unknown or other
  misc_feature (542)..(545): n is a, c, g, or t
  modified_base (547)..(550): a, c, t, g, unknown or other
  misc_feature (547)..(550): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgtacgttaggtacggacgtattacgtacgttttgagttggtcattacccggacgtggtgggacgaaacgggaccacggtcaccgtcgtcctcagcctccaccgaacggccacgtccgtccttccccgtcgccncccctcctccgaaacgacgcctaccctcggtcggggcacgcggacggcccgtcgggcgtcgcgtcggtacaacggtacctacttccgttacgtcgacgcctacgtgacgggtccggtcgcggtacgacgggtccagtacgtagcngacgnnncgncnnnaannnngnnnn

SEQ ID NO: 280518 - DNA, 516 bp, Homo sapiens
  misc_feature: GYAE6OF02FR8K3.47.38.D05.1.454.CMB.1.raw
  modified_base (200)..(200): a, c, t, g, unknown or other
  misc_feature (200)..(200): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
  modified_base (496)..(497): a, c, t, g, unknown or other
  misc_feature (496)..(497): n is a, c, g, or t
  modified_base (499)..(516): a, c, t, g, unknown or other
  misc_feature (499)..(516): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagaggtttcagggcagggtcaccatgaccagggacacgtccatcagtacagcctanatggagctgagcagtctgagactgacgacacggccgtgtattattgtgcgttagttacggacgattacgtacgttttgattggtctattacccggacgtggtaggggcaaagggccacggtcaccgtctcctnacgcctccaccaagggcccatccggtccttcccccgnggccacccctccgtccaagacgccacctcgtcggggcacgacgcggccctgggcctgccgtggtcaacggcctacttctatgtactactcgtgacggcgggtcgtggccgaagggcgtgactaagnncnnnnnnnnnnnnnnnnnn

SEQ ID NO: 280519 - DNA, 454 bp, Homo sapiens
  misc_feature: GYAE6OF02I5QEP.47.38.D05.1.454.CMB.1.raw
  modified_base (402)..(402): a, c, t, g, unknown or other
  misc_feature (402)..(402): n is a, c, g, or t
  modified_base (410)..(454): a, c, t, g, unknown or other
  misc_feature (410)..(454): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgtttttgatttggtcattacccggacgtgtggggcaaaagggcccacggtcacccgtctccgtcacgccctaccaccaacgggccccatcggtccttccccctggccacccctcctccaagagcacctctgggggcacagcggcctgggctgcctgtcaggactcttctacgtgagctctgaggcggtctggcgaacggcgaccataacggncagtgacnnnnnnnnnnnnnnnnnnnnnnnnnnnnnnnnnnnnnnnnnnnnn

SEQ ID NO: 280520 - DNA, 987 bp, Homo sapiens
  misc_feature: GYAE6OF02ICFLF.47.38.D05.1.454.CMB.1.raw
tcagagctcacgtacacgaccggtgctcgatttagtatctgatagttgggtttggggaggactcctcagttcaccttctcacaatgaggctccctgctcagctcctggggctgctaatgctctggtctcgtggatccgaggtggggattattgtgatcgactctacgtctcctacgtcctcccgtcgccccgtcacgttcggttggacgacggccccgggtcccttcccattccttccgtgccgtacgggttacctacgcccgaagaccgtcccccttcgtcggacgacgtaacgttaaagtacgggtaaaacttacccgtttaagttttaggtaacgttttacgggttaacccgtcggaaactaaaaaccggtcccgaacggggtccgtaaccggttccctaacccgtaccgtaaacccgttcgttacggtactttacgttttaacggtttttacggttaacccgttttttaacgggtccccgggggttccccggtttacccccgggggtttaccccgttacggtaacccggtttaaccggtttaccgtaaacccggtttccggggaaccgttaaacggggtttcggtacccgttaacgggtaccggaacccgttaacgtaaacggttttttaaccgtttttaaaccgtacgttttaaaacggtaaaaccgtttaccgaagtaaccggtaaagggttacggggttaggggtaaacgggtccgttaaccgggtaaaggttacgttacggttaccggtttaagggtttaccgtttttaacgttaaccgttcgggtacttaacggtttaccgggaaaccttaaacgggtaaccctttaaaacccgtaaacccttttacccgttaaccccggttaacggttacccgggtaccggtaacgggtacccgtaaccggtcccggttaacggtaaccgttaacgttacggtaacccttaacggttcggtacggtacgtccgtaccgtaccttacg

SEQ ID NO: 280521 - DNA, 682 bp, Homo sapiens
  misc_feature: GYAE6OF02GOT8K.47.38.D05.1.454.CMB.1.raw
  modified_base (197)..(197): a, c, t, g, unknown or other
  misc_feature (197)..(197): n is a, c, g, or t
tcagagctcacgtacacgaccggtgctcgatttagtatctgatagttgggtttgggggagcatcacccagcaaccacatctgtcctctagagaatcccctgagagctccgttcctcaccatggactggacctggaggatcctcttcttggtggcagcagccacaggagtccactcccagttgcaactggtgcagtcnggggctgaggtgaagaagcctgggcctcgagtgaaggtctccgtgcaaggtcttcgtggactacgagccttacaccgactactattgctacgtgggtgcggaccgggccctggacagggcttgagtggagtgggacgatcgacgccctaagaggtggtcggacaacgtaaacgtagtcgacgtaacgaggtacggtttcgacgggtcgtaggggtccaaccgtagtcggaaccgacggggacctaccgtaccgagtaccgaagtacacgtaccctaacgacgttaggacgtcgacggaacgcgtagtaccgtcggaaccgtaccgtacggaccggtaacggacccgggttaccgttaggttaacgtttacggttgggttaaccggtaccggttttaacgggttaaacccgggtaacgttaacggttttaacgggttaaccggtttttacgggtaacggttttccgggtaccgtttaaaccccggg

SEQ ID NO: 280522 - DNA, 403 bp, Homo sapiens
  misc_feature: GYAE6OF02I6IE5.47.38.D05.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (363)..(364): a, c, t, g, unknown or other
  misc_feature (363)..(364): n is a, c, g, or t
  modified_base (366)..(366): a, c, t, g, unknown or other
  misc_feature (366)..(366): n is a, c, g, or t
  modified_base (368)..(403): a, c, t, g, unknown or other
  misc_feature (368)..(403): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggccacggtcaccgtctccctnacgcctccaccaagggcccatcggtcttccccnggccaccctcctccaagagcacctcgtggggggcacacgcggccctgggctgcctggtcaaggactacttcctacgtgagctgtgagcggatggcaggcgcactagnngncnnnnnnnnnnnnnnnnnnnnnnnnnnnnnnnnnnnn

SEQ ID NO: 280523 - DNA, 655 bp, Homo sapiens
  misc_feature: GYAE6OF02HO149.47.38.D05.1.454.CMB.1.raw
  modified_base (174)..(174): a, c, t, g, unknown or other
  misc_feature (174)..(174): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
  modified_base (532)..(532): a, c, t, g, unknown or other
  misc_feature (532)..(532): n is a, c, g, or t
tcagagctcacgtacacgaccggtgctcgatttagtatctgatagttgggtttggggtgatcaggactcctcagttcaccttctcacaatgacgctcccgtgctcagctccgtggggctgactaagtcgactcgtgggtactcgtgatccgaggtgggtatattgtgatgactnagtctcactctcctcgaccctccacccgtggacgacggcccgtcctccacgtcctctgccgaggtactacgaccgagctccttacttacagtaagtaagtggtacttacgaacttagttcaagttcgtaacctgacgaagaacgcgaagggctacgtaccaccacagtcctcgtnattcgtggttcggtacngtacggtccggccgtccgggtcctagacgtacggttcgaggtcgagtaggtacgacgtacgagtactacgtaacgtttacgttaacgaacgtaagtaaactaggtaacgggtaggggtacgaggtagttacggtaagtaggtttaggttagggtttaatacggtanacgtacgtgaacgtaacgttaccttaaacgtaaccttactaacgttcgtacggtaccggtaacggtacgaaggcgtaggaagtaccgtaaacgaacgtacggtacgtcgtacgcgtacctacg

SEQ ID NO: 280524 - DNA, 620 bp, Homo sapiens
  misc_feature: GYAE6OF02GXFXQ.47.38.D05.1.454.CMB.1.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (597)..(598): a, c, t, g, unknown or other
  misc_feature (597)..(598): n is a, c, g, or t
  modified_base (606)..(606): a, c, t, g, unknown or other
  misc_feature (606)..(606): n is a, c, g, or t
  modified_base (608)..(620): a, c, t, g, unknown or other
  misc_feature (608)..(620): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagagtttcagggcagggtcaccatgaccagggacacgtccatcagtacagcctacatggagctgagcagtctgagacctgacgacacggccgtgtatttatgtgcgtttagtacggacgtaatacgtcgtttgattggtcagttacccggaggttggngggacgaaacgggacctacgggtcaccggtcttccncgacgtccctcccgaacccgaacgggcccctacgtacccgtcccgttttcccccgacgggcccctaacccccttcccgtaacccaaacggtacgcccgtaaccctcgggttacgggggcccaacgccgggacccggtccccggtaggggtccgttcgggcccgttacggggtactaaacgggtacccttaccgtttacccgacgggttagaccgtcgtcgtggacgggccgggtcgtcggacgaacggcgacacgtagnnacgtgctncnnnnnnnnnnnnn

SEQ ID NO: 280525 - DNA, 605 bp, Homo sapiens
  misc_feature: GYAE6OF02FJAZR.47.38.D05.1.454.CMB.1.raw
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
tcagagctcacgtacacgaccggtgctcgatttagtatctgatagttgggtttgggtgcccaagctgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggtccgtgtattattgtgcgttagttacggacgattacgacgttttgattggtcattacccggagtgtggggcaaagggcacggtcacgtctcctcagcctccacaacgggcccagtcggtccttcccctcggtccaccccttcctccaagacgccgtaaccctcggttcgggggacctaccgacggcccgggtcccgtacggggccgttcggcccgttagggttaccgaaacgggtacccttaaccgtttcccttaacgggtcggtaacggtccttaccgtggtaacgggccgggtccgtagggaccgaagggccgacgtagttaacgngngtcgcngtacngacggcagtacccgnagnactgancngngtg

SEQ ID NO: 280526 - DNA, 485 bp, Homo sapiens
  misc_feature: GYAE6OF02HV4DZ.47.38.D05.1.454.CMB.1.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (445)..(445): a, c, t, g, unknown or other
  misc_feature (445)..(445): n is a, c, g, or t
  modified_base (450)..(485): a, c, t, g, unknown or other
  misc_feature (450)..(485): n is a, c, g, or t
tcagagctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggcgtgtattattgtgtcgttagttacggacgtattacgtacgttttgattggtctagttaccggacgtgtgggacaaagggcctacggtcaccgtctcctcagcctcaaccgaacggcctagttccgtcctttccccngcctacctccacctaagacnccacctgtacggggcacggacgcccggccgtgggctgaccgtcggttacgaaacgggtccttaacgttcccgttaacgtggtcggaccttcgtcggaacgggtcgggtcgtcggccgtaacgggcgacaagtcgtncgtannnnnnnnnnnnnnnnnnnnnnnnnnnnnnnnnnnn

SEQ ID NO: 280527 - DNA, 865 bp, Homo sapiens
  misc_feature: GYAE6OF02H0X7V.47.38.D05.1.454.CMB.1.raw
  modified_base (476)..(476): a, c, t, g, unknown or other
  misc_feature (476)..(476): n is a, c, g, or t
tcagagctcacgtacacgaccggtgctcgatttagtatctgatagttgggtttggggaggactcctcagttcaccttctcacaatgaggctccctgctcagctcctggggctgctaatgctctgggtctcgtggatccgaggtggggtatattgtgatgactcagtctcccactcctccccgtcgtccccgtccacccccgtgggacgacggcccggcctacccacttcctcccgtgccgtaggtcctacgccgagacgccttcttaacgagtaacgtaagtggtattaccaactttagtttagtaacgtttacggtacctgacgtaagaacggccgtaacgggctaaccgtccgtaccaacgacgccttacgtacgtacgttcgtttcgggttttcggttcgttcggtaaccggttcccggggtccccgggttcccgggggttacccgtaacgggtaccgttacgggtttaccgnggggtttccggaacggtacggttacgggtaacgttccggaacggttcctaacggttaacgtttacgttttacggacgtaaacgtaaacgttacggtaacgggttaggggtacgggtaacgggtaccggttagggtagggttaacgtttgggggttttaacgggtttaacgtttacggtacgtacgtacgttacggtaacgttaaacgtttaaccgtaaacctttaaaccgttccgttttaaccgttacgtttaaccggacccgggttaaacggtaccggtaacggttaccggttaacggtaaacggtaaaccgtaccgtaaaacggttaccggttcggtaaccgggttccgtaaccgttaaccggacctttacggtacccgtttaccgg

SEQ ID NO: 280528 - DNA, 400 bp, Homo sapiens
  misc_feature: GYAE6OF02GRSX8.47.38.D05.1.454.CMB.1.raw
  modified_base (382)..(400): a, c, t, g, unknown or other
  misc_feature (382)..(400): n is a, c, g, or t
tcagagctcacgtacacgaccggtgctcgatttagtatctgatagttgggtttgggtgcccaagctgctggagggcacggtcaccacgctgctgagggagtagagtcctgagacctgacgacacggccgtgtattattgtgcgttagttacggacgattacgacgttttgattggtcattacccggacgtgtggggcaaagggaccacggtcaccgtctcctcagcctccaccaacgggcccatcggtccttccccctggccaccctcctccaagcgccacctcgtcgggggcacgagccggcccgtcgggctcgccgtggtcgaacggacctaccttccgtacgtgagtctcgtgaggcgggcgtcggacgaggcgcatgnnnnnnnnnnnnnnnnnnn

SEQ ID NO: 280529 - DNA, 497 bp, Homo sapiens
  misc_feature: GYAE6OF02FSGRT.47.38.D05.1.454.CMB.1.raw
  modified_base (453)..(497): a, c, t, g, unknown or other
  misc_feature (453)..(497): n is a, c, g, or t
tcagagctcacgtacacgaccggtgctcgatttagtatctgatagttgggtttggggtgcccaagctgctggagggcagggtcaccatgaccagggacacgtccatcagtacagcctacatggagctgagcagtctgagacctgacgacacggccgtgtattattgtgcgttagttacggacgattacgtacgtttttgatttggtcacttacccgggacgttggtcggggacaaagggccacggtcaccgtcctcctcagccctccaccaagggccccagtcggtcccttcccccgtcggccacccctccctaccaacgacgcaccctcgtcgggggcacgacgccggcccgtcgggctcggcctggtaccaacggtaccttaccttcccgtacgttgacgtctcgtgacggccggggtcgtcggaccggaagggccgtacgaagtagacgnnnnnnnnnnnnnnnnnnnnnnnnnnnnnnnnnnnnnnnnnnnnn

SEQ ID NO: 280530 - DNA, 623 bp, Homo sapiens
  misc_feature: GYAE6OF02G0DAQ.47.38.D05.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
  modified_base (547)..(547): a, c, t, g, unknown or other
  misc_feature (547)..(547): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (604)..(604): a, c, t, g, unknown or other
  misc_feature (604)..(604): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
tcagagctcacgtacacgaccggtgctcgatttagtatctgatagttgggtttgggtgcccaagctgctggagggcacggtcaccgacgctgcttgagtggatgggacggatcagccctaacagtggtcggcacgaaaactatgacanagtaggtttcgagggcagggtcaccatcgaccgagggacacgtccatcagtacacgtcctanagtgganctgagtcagtcgtagacgacctgaacgacacggtcgtgtaattagttgtgtagttacggttacggacgtagtaacgtacgtttgagttggtactacgttaccggacgtggtgggacgaaacggtaccgacggtcgaaccgtctcctacgancctaccaaccgaacgcccagtccgtccttcccgcggtccacccgtactaccgtaagacncctacgtccggtacgggactacgacggcccggtaccgtgggtacctacggtcccgtagggtaccgaaaacggtccctttacccgttaccgtcgtacgacgtctacgttacgaggtccggngtacggaccgtaagccgtacaagttccganacgtanacgntagagtcagtcacgtangtacactacganagngncg

SEQ ID NO: 280531 - DNA, 522 bp, Homo sapiens
  misc_feature: GYAE6OF02H79P2.47.38.D05.1.454.CMB.1.raw
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (477)..(478): a, c, t, g, unknown or other
  misc_feature (477)..(478): n is a, c, g, or t
  modified_base (480)..(484): a, c, t, g, unknown or other
  misc_feature (480)..(484): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (499)..(503): a, c, t, g, unknown or other
  misc_feature (499)..(503): n is a, c, g, or t
  modified_base (506)..(506): a, c, t, g, unknown or other
  misc_feature (506)..(506): n is a, c, g, or t
  modified_base (508)..(510): a, c, t, g, unknown or other
  misc_feature (508)..(510): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (517)..(521): a, c, t, g, unknown or other
  misc_feature (517)..(521): n is a, c, g, or t
tcagagctcacgtacacgaccggtgctcgatttagtatctgatagttgggtttgggtgcccaagctgctggagggcacggtcaccacgctgctgaggggagtagagtcctgagacctgacgacacggccgtagtattatgtgcgtttagtacggacgattacgacgttttgattggtcattacccggagtgtggggcaaagggccacggtcaccgtctcctcacgcctccaccgaagggcccatccggtccttccccnggccaccctctaccaagcnccacctcgtcgggggcacgacgccggcccgtggcctcgccgtggaccgtaacggaccttaccgttccgtacggtcgagccttcgtgacggcgggtccggtcggacgtaacgggccgtagacgtaaggtcagactganacgngtnctgctgagnttcggatcgtancctnaccggatgntaacgctacagtncggttancnncnnnnnanatnganacnanannnnngcncnnngnancgnnnnnc

SEQ ID NO: 280532 - DNA, 463 bp, Homo sapiens
  misc_feature: GYAE6OF02HIVSL.47.38.D05.1.454.CMB.1.raw
  modified_base (283)..(283): a, c, t, g, unknown or other
  misc_feature (283)..(283): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (419)..(463): a, c, t, g, unknown or other
  misc_feature (419)..(463): n is a, c, g, or t
tcagagctcacgtacacgaccggtgctcgatttagtatctgatagttgggtttgggtcgcccaagctgctggagggcacggtcaccacgctgctgagcagtctgagacctgacgacacggcctgtattattgtgcgttattacggacgattacgaacgtttttgaattggtacatttaccccggacgttgtaggggacaaaagggccacggtcaccgtctcctcagcctccaccaagggcccatccggtcttccccctggcacccctcctccaagagcacctntggggcacagcgcccctgggctcgcctggtcaaggacttacgttccctaaggttgaagctcgtgaagccgggtctagggacaacgggcgactagtagnatgctancacatgcagtcgtcagcatccaatgcagcannnnnnnnnnnnnnnnnnnnnnnnnnnnnnnnnnnnnnnnnnnnn

SEQ ID NO: 280533 - DNA, 465 bp, Homo sapiens
  misc_feature: GYAE6OF02G2CWW.47.38.D05.1.454.CMB.1.raw
  modified_base (435)..(465): a, c, t, g, unknown or other
  misc_feature (435)..(465): n is a, c, g, or t
tcagagctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgtacgttttgattggtcattacccggacgtggtggggcaaaggggccacggtccaccgtctcctcacgcctccgaccaacgggccccagttccggtccttccccccgtggccaccccctccctcccaaaggacgccacccttcggtacggggggccaaccgacggccgggccccgttgggcctcggcccgttggtaccaagggtaccttaaccttcccgtacggtgaacgccgttcgtacggacggtccggggcgtcggaccgaagggcgacgtagtcgcnnnnnnnnnnnnnnnnnnnnnnnnnnnnnnn

SEQ ID NO: 280534 - DNA, 726 bp, Homo sapiens
  misc_feature: GYAE6OF02G0DW7.47.38.D05.1.454.CMB.1.raw
  modified_base (696)..(696): a, c, t, g, unknown or other
  misc_feature (696)..(696): n is a, c, g, or t
  modified_base (700)..(700): a, c, t, g, unknown or other
  misc_feature (700)..(700): n is a, c, g, or t
  modified_base (704)..(704): a, c, t, g, unknown or other
  misc_feature (704)..(704): n is a, c, g, or t
  modified_base (706)..(706): a, c, t, g, unknown or other
  misc_feature (706)..(706): n is a, c, g, or t
  modified_base (708)..(708): a, c, t, g, unknown or other
  misc_feature (708)..(708): n is a, c, g, or t
  modified_base (711)..(713): a, c, t, g, unknown or other
  misc_feature (711)..(713): n is a, c, g, or t
  modified_base (724)..(724): a, c, t, g, unknown or other
  misc_feature (724)..(724): n is a, c, g, or t
  modified_base (726)..(726): a, c, t, g, unknown or other
  misc_feature (726)..(726): n is a, c, g, or t
tcagagctcacgtacacgaccggtgctcgatttagtatctgatagttgggtttgggtgcccaagctgctggagggcacggtcaccacgctgcttgagtggatggggacggatcacgccctaacagtggtggcacaaactatgcacagaggtttcagggcagggtcaccatgaccagggacacgtcatcagtacagacctacatggagctgagtcagtcctggacgacctaggaccgacgaccgggtccgttagtaatttgtggttgtacggtttagttaccggacgttaagtttacggttacgttttgtagtttcggtacgtaccgttacccgggacggttcgggtacggggaaccgtaaacggggtacccggtaaccggtacctacccggtccgtaccccttcgaccgtcccgtacccaaccggaaccgggtcccctaacgttacccgggttcccttcccccgtccggccctaccccgttaccctacccgaacgtaccgtcccgtaccgttaccgggtcgggggacccacggtacggcccgggtccggtacgggtcctaccgggtccggttagggtaccgtaaacgggtcccgtttaaccgttccggttaccggtcggtacgttcgtaccgcgggtaccgggtcggacgggttcgaccgggacgggtccgtacgtaacgtcggacagtccgagtnacgngtcngngngcnnncgcactactcntn

SEQ ID NO: 280535 - DNA, 447 bp, Homo sapiens
  misc_feature: GYAE6OF02JITXU.47.38.D05.1.454.CMB.1.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (396)..(397): a, c, t, g, unknown or other
  misc_feature (396)..(397): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (406)..(447): a, c, t, g, unknown or other
  misc_feature (406)..(447): n is a, c, g, or t
tcagagctcacgtacacgaccggtgctcgatttagtatctgatagttggggtttgggtgcccaagctgctggagggcagggtcaccatgaccagggacacgtccatcagtacagcctacatggagctgagcagtctgagacctgacgacacggccgtgtattattgtgcgttagttacggacattacgacgtttttgattggtcattacccggacgtgtgggcaaagggaccacgggtcaccggtctcctcagcctaccaccagggccccatcggtcttcccctggcacctcctccaancgcacctctcgggggcncgagccggcctgggctcgccgtggtccaaggactaccttcctacgtgacgctcgtgaggcggctggctacggcgcatagnngntcngcgnnnnnnnnnnnnnnnnnnnnnnnnnnnnnnnnnnnnnnnnnn

SEQ ID NO: 280536 - DNA, 742 bp, Homo sapiens
  misc_feature: GYAE6OF02H6LAB.47.38.D05.1.454.CMB.1.raw
  modified_base (328)..(328): a, c, t, g, unknown or other
  misc_feature (328)..(328): n is a, c, g, or t
tcagagctcacgtacacgaccggtgctcgatttagtatctgatagttgggtttggggtgatcaggactcctcagttcaccttctcacaatgaggctccctgctcagctcctggggctgctaatgctctgggtctctggatccgaggtgggatattgtgatgactcagtctccactcctccctcgcccgtccaccccgtggagcgccggcctcatcctcctgcaggtctagccagacgtccttcttaacaagttagtaagtggtaactttacaactttatttggtaatttcggtacctgacaagaacgcccgaggctacgtccaccacngcctcgtagacttcgtttggtttcggtctaggtcggtcccgggtacccggttccggggtacctaggacgttcggttacctcggtcggacgtagggtacggtacgtacggacggtacaacggttaacgtttaacttttaacgtaaagtttaaacgtaaaacgtcgtaaacggtaaccggtagggttaagggttaccggggacggttaacccggtaggtaacgggttacgttacgggtaccggtttaagggtttaaacgtttttacgttaacgttacggtacgtaacgttaacgtaaccgtaaaacttaaaccgttaaaacccttaccctttacccgtttacccgtaccggtacggaacccgtaacggaacgtaccggtacgtacgtaactacgtaacggacgtaacgtgtaccgg

SEQ ID NO: 280537 - DNA, 365 bp, Homo sapiens
  misc_feature: GYAE6OF02GCVKS.47.38.D05.1.454.CMB.1.raw
  modified_base (359)..(365): a, c, t, g, unknown or other
  misc_feature (359)..(365): n is a, c, g, or t
tcagagctcacgtacacgaccggtgctcgatttagtatctgatagttgggtttgggtgcccaagctgctggagggcacggtcaccacgctgctgagcagtcttgagacctgacgacacggccgtgtattattgtgcgttagttacggacgattacgacgttttgacttaggtcaattacccggaacgtgtggggcaaagggaccacggtcaccgtctcctcagcctccacccaagggcccatcggtcttccccctggccaccctcctccaagagcacctcgtgggggcacagcggcctgggctgcctggtcaaggctacttcctacgtgagctctgagcgggctggcaaggcgcatagnnnnnnn

SEQ ID NO: 280538 - DNA, 466 bp, Homo sapiens
  misc_feature: GYAE6OF02FO1GP.47.38.D05.1.454.CMB.1.raw
  modified_base (273)..(273): a, c, t, g, unknown or other
  misc_feature (273)..(273): n is a, c, g, or t
  modified_base (417)..(423): a, c, t, g, unknown or other
  misc_feature (417)..(423): n is a, c, g, or t
  modified_base (425)..(466): a, c, t, g, unknown or other
  misc_feature (425)..(466): n is a, c, g, or t
tcagagctcacgtacacgaccggtgctcgatttagtatctgatagttgggtttgggtgcccaagctgctggagggcacggtcaccacgctgctgagggagtagagtcctgagactgacgacacggccgtgtattattgtgcgtttagttacggacgattacgtacgtttttgattggtcattacccggacgtggtggggcaaagggaccacggtcaccgtctcctcaggccctacccaccaaggggcccacgtccgggttcctttcccccccngggtcccaccctccctccaagcgccacctccggtgggggcacgacgcggcccctgggcctggccttggtacgaacggaccttacttacccgtacggtgacgtcctcgtgaggccgggtctggacgaagggcgacgatagcagtnnnnnnngnnnnnnnnnnnnnnnnnnnnnnnnnnnnnnnnnnnnnnnnnn

SEQ ID NO: 280539 - DNA, 577 bp, Homo sapiens
  misc_feature: GYAE6OF02FXSMX.47.38.D05.1.454.CMB.1.raw
  modified_base (125)..(125): a, c, t, g, unknown or other
  misc_feature (125)..(125): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (521)..(526): a, c, t, g, unknown or other
  misc_feature (521)..(526): n is a, c, g, or t
  modified_base (528)..(531): a, c, t, g, unknown or other
  misc_feature (528)..(531): n is a, c, g, or t
  modified_base (533)..(534): a, c, t, g, unknown or other
  misc_feature (533)..(534): n is a, c, g, or t
  modified_base (536)..(541): a, c, t, g, unknown or other
  misc_feature (536)..(541): n is a, c, g, or t
  modified_base (545)..(549): a, c, t, g, unknown or other
  misc_feature (545)..(549): n is a, c, g, or t
  modified_base (552)..(555): a, c, t, g, unknown or other
  misc_feature (552)..(555): n is a, c, g, or t
  modified_base (557)..(558): a, c, t, g, unknown or other
  misc_feature (557)..(558): n is a, c, g, or t
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (568)..(571): a, c, t, g, unknown or other
  misc_feature (568)..(571): n is a, c, g, or t
  modified_base (574)..(577): a, c, t, g, unknown or other
  misc_feature (574)..(577): n is a, c, g, or t
tcagagctcacgtacacgaccggtgctcgatttagtatctgatagttggggtttgggtgcccaagctgctggagggcagggtcaccatgaccagggacacgtccatcagtacagcctacatgganctggagcagtctgagacctgacgacgacggccgtgtattattgtgcgttagttacggacgtatttacgacgtttttgatttggtcaagtttacccggacgttggtcggggacaaaagggccaacgggtcaacccgttcacctcacgccctaccccgaaccaacgggccccagtccggttcccttccccccgtggcctaccccctccttacccaaagacgtccacccgttcgtcgggggccaaccgacggcccggtccccgtacggggtcttcggccgttacggtaaccggaaaggtaaccctttaccgtttccctaacggttcgaccggtccttacgtagacgggtccgggcgttacgggacgaagggccgactaacgtaagctanacgnanagcnnnnnnannnnanngnnnnnngacnnnnngcnnnncnnanncntnacnnnntannnn

SEQ ID NO: 280540 - DNA, 618 bp, Homo sapiens
  misc_feature: GYAE6OF02GD0HU.47.38.D05.1.454.CMB.1.raw
  modified_base (599)..(603): a, c, t, g, unknown or other
  misc_feature (599)..(603): n is a, c, g, or t
  modified_base (605)..(618): a, c, t, g, unknown or other
  misc_feature (605)..(618): n is a, c, g, or t
tcagagctcacgtacacgaccggtgctcgatttagtatctgatagttgggtttgggtgcccaagctgctggagggcacggtcaccacgctgcttgagtggatggggacggatcagccctaacagtggtggcacaaactatgcacagaggtttcagggcagggtcaccatgaccagggacacgtccatcagtacacgcctacatggagctgagcagtctgacgacctgacgacacgggtccgtgtaattattgtgtcgttagtacggacgtattacgtacgttttgagttggtctacgttacccggtaggtgggtggggaacgaaacgggacctacggtcaccgtcctcctacacgtccctaccaaccgaacgggtccctacgttccggttcccttcccccgtcggccctaccccgtcctaccgaaacgacgccctacccggttccgggtcggggacctaacggcggcccgggtccccggtgggacccgtcggtcccgttagggtaaccgaaacggtaccttacctttccgtaagttacgttacgttacctgtacggacggccgggtcgtacggaccgtaacgggctacgtagagtcgannnnngnnnnnnnnnnnnnn

SEQ ID NO: 280541 - DNA, 186 bp, Homo sapiens
  misc_feature: GYAE6OF02GEDGQ.47.38.D05.1.454.CMB.1.raw
  modified_base (174)..(186): a, c, t, g, unknown or other
  misc_feature (174)..(186): n is a, c, g, or t
tcagagctcacgtacacgaccggtgctcgatttagtatctgatagttgggtttgggggaagaggaagactgacggtccccccaggagttcaggtgctgggcacagcggccctgggctgcctggtcaaggactacttcctacgtgagctctgagcgggctggcaaggcgcatagnnnnnnnnnnnnn

SEQ ID NO: 280542 - DNA, 886 bp, Homo sapiens
  misc_feature: GYAE6OF02FYK94.47.38.D05.1.454.CMB.1.raw
tcagagctcacgtacacgaccggtgctcgatttagtatctgatagttgggtttggggaggactcctcagttcaccttctcacaatgaggctcctgctcagctcgtgggctcctgctgctctggctccgaggtcgacaatgtagacactccagtatcgaccctagttcctccttacccacccgttgtccgttcgactacgttcgtcggtacggaacgaacgtacggtactaccgaaacctacgttaccgtaaccgttcgggacccgggtacctaacggttaccgtaaggtaacgtttagttaacgggtaacgtttaggggtacgggtttccgggtaccgttagggttaactaccggaacggtaaccgtaaacggaaaccggtaacgggtaaacccgtacccgttacggtaaacctttacgttaaactttacggtaaccgtaacgggttaccgtttaacttaaacggttttaaccggtaaacggttccggggttaaccctaacggtttaacgtaacggtttaccggaacgggaccggtaacgtaaggttacggacgttacgggtacggtaacgtacgttacggtttacccgactttacgacccaaccgtaacggttaaccccaaacgtccgggtaacaccggtacggtacccttaagggtacttagtttaacccgttagggaaccctttaagtttaccgtaacgtaaccggtaaacggttaaacttaagtaccggttaacttccggttacccgtacggtttaccggttaccggaccgggtttaacgaacggttaggaaccttggttaaccgaaccgtagttgtacgggtactacggtcaaccgtacgttagtaccgttctcggttataccgtcgtacccgtataccgg

SEQ ID NO: 280543 - DNA, 721 bp, Homo sapiens
  misc_feature: GYAE6OF02HN9MY.47.38.D05.1.454.CMB.1.raw
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
tcagagctcacgtacacgaccggtgctcgatttagtatctgatagttgggtttggtgcccaagctgctggagggcagggtcaccatgaccaggacacgtccatcagtacagcctacactggagcttgagcagtctgagacctgaccgacgaccggccgtgtattatgtgcgttagttacggacgattacgtacgttttgagttggtcaagttacccggacgtgtgggacaaagggccacggtcaaccgtctcctacgacgccctccaaccgaacggcccctacgtccggttccctttaccccccgtcggtacccaccccctaccccgttaccgaaacggacgtaccgtaacccgtcggttcggggggacccaaccggtaccggcccgggtccccggtcggggccgtcggtcccggttacggtaccgtaaacgggtaccgttaccgttaacccgttaaccggtacgaacggtcctcggttacggtacggaccggggtccgtagggaccgtaaacgggccgtaacgtaagtaacgcgacgacgagcttgacgngtcnctcgatacgtcgactacgacgtacgacgacgtacgtacgcgtcggtacgacgtacgtaccgacgtacggtacgtacggtacgacgtaacgtacgtacgtacgtacgtacgtacgtacgtaacgtagaccgtacctacgtacggtacgtaacgtacgtacgtacgcg

SEQ ID NO: 280544 - DNA, 759 bp, Homo sapiens
  misc_feature: GYAE6OF02H8U0N.47.38.D05.1.454.CMB.1.raw
  modified_base (601)..(601): a, c, t, g, unknown or other
  misc_feature (601)..(601): n is a, c, g, or t
tcagagctcacgtacacgaccggtgctcgatttagtatctgataggttgggtttgggggagcatcacccagcaaccacatctcgtcctctagagaactcccctagagagccttccgttccaccaccagtggacgtcggaacgtgggaggacgttcctcgttcgttgggtcggcagacacgcccagaggaccgtacccacctccgtaggtacgacaacgtggtgccgaggtcggtgggcgtagggtagtaggaaaggacggtccggtacgggaccgtagaagtacggtaacgttcgtcgagacgtacgttccgttgtaacggtaacgtacgtacgtacgttacgtaccgtacttaactacgttacgacgtacggtggtacggtaccggaccggtaccgaggaacggtacgtcgtacggtaggtaggaggtacggtacgtacacgaacgtaccgtaacgacggtaggtacgaacgtaacgtaaacgtcgtacgacgtaacgtacggtacggttacggacgggtaccgtacggactaaccggtaacgaccggaacggtacgacgtaccggtaccacgtaacggtacaccgaacgtaccgtaagnggaacgtacgacggtaagacgtacgtgtaccggataaccggagaccggtaaccgaacggtccgttagtagttaacggtttacgtggtaaccgttagtaacccggtttaagaacgtttcggtaacgtttggttaacgtttcggttacgtaccgttacgg

SEQ ID NO: 280545 - DNA, 415 bp, Homo sapiens
  misc_feature: GYAE6OF02JQSW3.47.38.D05.1.454.CMB.1.raw
  modified_base (97)..(97): a, c, t, g, unknown or other
  misc_feature (97)..(97): n is a, c, g, or t
  modified_base (225)..(225): a, c, t, g, unknown or other
  misc_feature (225)..(225): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (383)..(384): a, c, t, g, unknown or other
  misc_feature (383)..(384): n is a, c, g, or t
  modified_base (387)..(415): a, c, t, g, unknown or other
  misc_feature (387)..(415): n is a, c, g, or t
tcagagctcacgtacacgaccggtgctcgatttagtatctgatagttgggtttgggtgcccaagctgctggagggcacggtcaccacgctgctgagnagtctgagacctgacgacacggccgtagtattattgtgcgttagttacggacgattacgacgttttgattggtctacttacccggacgtggtggggcaaagggaccacggtctacccgtctccttacncgccctccacccaagggcccagtccggtccttccccctggccacccctcctccaagacgccaccttcgcggggcacagcccggcccgtgggctcggctgagaggccttactcctcgngacgtctcgtagacggccgggntcgaccgaggcctnaagtnncgnnnnnnnnnnnnnnnnnnnnnnnnnnnnn

SEQ ID NO: 280546 - DNA, 795 bp, Homo sapiens
  misc_feature: GYAE6OF02HZDX5.47.38.D05.1.454.CMB.1.raw
tcagagctcacgtacacgaccggtgctcgatttagtatctgatagttgggtttgggggagcatcacccagcaaccacatctgtcctctagagaactcccctgagagctccgttcctcaccatggactggacctggaggatccttcttcttggtggcagcagccacaggagtccactccctagttcgactaacgtggtgcagtcgtggggtctgaggtgaaagacgccgtaggggcctcgagtacgaaggtctccgttaggacgtaacggtaccttcgtaggaacgtaacgtaacgtcctttaccgaacccggtaacttaacgttacgttttagaccttacggtacggggttacgaccggtaacccgggtcccccgttaagggaaccggtaaacgggtccgtttagggaacggttagggaacggttacgggtaccgggaacgttacgaaccgtaacccttaaacgtacgggtagggtacgggaacctaacgtaaaacgtcgtaacgactaacgtaggtacggtttaccgagggtacgacgggtacacgagtacggaacgaggacctacgtctaacttcgaagtaccacgactaacgacgtcgaacgtacgtacggagtaccgtaagtacgtacgaaccgtaaccgtacgaacggtaacccgtaaccggggtcctttaaggttacggtttacgttggttaaccggttacgtttaaccgggttaaccggttaacggttaaccgttttaaccggtttaagtttttccggtacggtttaccgggttaccgttaaacccgg

SEQ ID NO: 280547 - DNA, 631 bp, Homo sapiens
  misc_feature: GYAE6OF02IKDV5.47.38.D05.1.454.CMB.1.raw
  modified_base (292)..(292): a, c, t, g, unknown or other
  misc_feature (292)..(292): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
  modified_base (558)..(559): a, c, t, g, unknown or other
  misc_feature (558)..(559): n is a, c, g, or t
  modified_base (564)..(564): a, c, t, g, unknown or other
  misc_feature (564)..(564): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (595)..(595): a, c, t, g, unknown or other
  misc_feature (595)..(595): n is a, c, g, or t
  modified_base (609)..(609): a, c, t, g, unknown or other
  misc_feature (609)..(609): n is a, c, g, or t
  modified_base (627)..(627): a, c, t, g, unknown or other
  misc_feature (627)..(627): n is a, c, g, or t
tcagagctcacgtacacgaccggtgctcgatttagtatctgatagttgggtttgggtgcccaagctgctggagggcacggtcaccacgctgctgagcagtctgagacctgacgacgacggccgtgtatttattgtgcgtttagttacggacgattacgtacgtttttgagttggtcaagtttacccggacgttggtcgggggacaaaacgggccctaacggtccaaccgtccttcctacgacgtccctaccaaccgaaacgggccctaacttccggttccctttccccccgnggaccctaccccctccgtaccgaacgacgcctacccgtcggttgggggacctacgacggtcccggccccgtagggccttcggcccgttggtaccgaaacgggtacctttacccgtttcccctaacggttcggaacgtcccgttcggttcgggaacgggtccgggtaccgttacgggaccgaaacggggtccaacgtaggttaagctgtcacggngngctncgacgcngctnctcncgangnngtngcanatnncngcacncgcgcnngctcnctacgcgcgngcnctcgcgacgcgtgtcacnctcgtactacacgngtatgtacgtctagtcgnagcg

SEQ ID NO: 280548 - DNA, 581 bp, Homo sapiens
  misc_feature: GYAE6OF02GC2IB.47.38.D05.1.454.CMB.1.raw
  modified_base (280)..(280): a, c, t, g, unknown or other
  misc_feature (280)..(280): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (535)..(536): a, c, t, g, unknown or other
  misc_feature (535)..(536): n is a, c, g, or t
  modified_base (538)..(581): a, c, t, g, unknown or other
  misc_feature (538)..(581): n is a, c, g, or t
tcagagctcacgtacacgaccggtgctcgatttagtatctgatagttggggtttgggtgcccaagctgctgggagggcagggtcaccatgaccagggacacgtccatcagtacagcctacatgggagctggagcagtctgagacctggaccgacgaccgggccgttagttaatttagtttggtgtacggtttaggttaacggacgtaatttacggtacgtttttgattggtcacgttacccggagtgggtgggacgaaagggcctacggtccaccgtccncctacgacgccctacccgaaccgaaccggccccgtagttcccgggttccccttacccccgtaggcccctaaccccccgttcctacccggaaagtaccgccacccgttcgggtcggggactaaccggcggcccggtcccggtggaccgtcggccgtcgggtacgaacggttacctaccgtttcaagttcttacgtaccgttggcgtagggccggtcgaaccgggtacgacggtccgaacgtagtacggngangcanncnnnnnnnnnnnnnnnnnnnnnnnnnnnnnnnnnnnnnnnnnnnn

SEQ ID NO: 280549 - DNA, 719 bp, Homo sapiens
  misc_feature: GYAE6OF02IV0M4.47.38.D05.1.454.CMB.1.raw
  modified_base (145)..(145): a, c, t, g, unknown or other
  misc_feature (145)..(145): n is a, c, g, or t
  modified_base (237)..(237): a, c, t, g, unknown or other
  misc_feature (237)..(237): n is a, c, g, or t
  modified_base (694)..(694): a, c, t, g, unknown or other
  misc_feature (694)..(694): n is a, c, g, or t
  modified_base (703)..(703): a, c, t, g, unknown or other
  misc_feature (703)..(703): n is a, c, g, or t
tcagagctcacgtacacgaccggtgctcgatttagtatctgatagttgggtttgggtgcccaagctgctggagggcacggtcaccacgctgcttgagtggatggggacggatcgacgccctaacaggtggtggcaacaaaactangacacgagtacggtttcaggggcagggccaccgatgaaccgaggaccaccgtccatcacgtacacgtcctacgagtggagtccgtgacgacngtcgtgactaccgtcgaaccgacgtaccggccggttattagtttagttcgtgtacgttacggtacggtaacgtagttacgttacgttttagtacgttcggtactaccgttaccggtacgttaggtcgggaaccgtaaacggaccgtacgtccgaccgttccgtaccgtcgtacgtcccctaccgaaccgtaacggccccgtacgttcccggttaccgttccccgttcgaccccgtacccctaccgtaccgtaaccggcgtaccctaacccggtccggtacgggacccgacgtaccggcccggtccggtaccgggtcctcgggtacccggtacgtaccggtaacgtacccgtttactaccgtacggtcgacgtcctcgtacggaccggtacgtccggtacgaccgtacgggaccttaccgagacgtacgtagcgcgtcgcgtagtacgtacgcgtagntagcgtacncgacgacgacgtagtg

SEQ ID NO: 280550 - DNA, 532 bp, Homo sapiens
  misc_feature: GYAE6OF02GAX72.47.38.D05.1.454.CMB.1.raw
  modified_base (376)..(376): a, c, t, g, unknown or other
  misc_feature (376)..(376): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (487)..(532): a, c, t, g, unknown or other
  misc_feature (487)..(532): n is a, c, g, or t
tcagagctcacgtacacgaccggtgctcgatttagtatctgatagttgggtttgggtgcccaagctgctggagggcagggtcaccatgaccagggacacgtccatccagtacagcctacatggagctgaggcagtctggagaccctgacgacaccggccgtgtattattgtgtcgttagtacggacgattacgtagttttgattggtcagttacccggagtggtgggacaagggaccacgtcaccgtcctcctacagcctacccgaccgaaacggggccccaagtccggtccctttccccccgttggcccacccccttccctcccgaaagccgcctacccgtcggtcggggtcaccgacggccggcccgtgggccncgtccgtgggtcaaggtacctaccttccgtacggtgtacgcgttactggacgggtccgggtcgtcgggaccggtaacggccgtaacgaattacggacgngntcggtnacgnnnnnnnnnnnnnnnnnnnnnnnnnnnnnnnnnnnnnnnnnnnnnn

SEQ ID NO: 280551 - DNA, 920 bp, Homo sapiens
  misc_feature: GYAE6OF02IG3LV.47.38.D05.1.454.CMB.1.raw
tcagagctcacgtacacgaccggtgctcgatttagtatctgataggttgggtttgggggagcatcacccagcaaccacatctgtcctctagagaactcccctgagagcctccgttcctcaaccagtcggactggacctggacggtacttcccgtcttcgttagggtcggaccagcaacggccaaccgaggtaccgtcccaccgttacccgtaggttcgacctaacgttgggtcgtaccgtaggttccgggttggggacgttacgggaaaggggttacggaaaaggtaacggtcccgggttcgggggaccccttacgtaagggttacgggaaacgggtttccctacccggttagaccgggtaaagtccgtttaccgtacgggtaactaccgaacgttccgttaaccaacccgggttaacttaacggttacgttttacggaccctaacggtcgggggtttccgaaccggggaaccccggggttacccccgttaaggggaacccggtaacggggttaccctttaggggaaccggggttagggtaacgggtttaccggggaaacgggtaccgttaaccggaccggtaaaccccgttagggacgtttacgggacggtaccaaaccggttaagttaacggacacggtactaacgggttaacgggttccgagggtaccgacgggtaccgaacgtacgtaccggaacggaccggtaacgtaaccgtacctaggaccgtaacgtaccgaaccgttcgaacgtacggtacggactcggtacgaccgtacgttacgacgttacggtacgacgttacggaccgtacgggtaccggacgtttacggtagtttacggttgtacggttacgttaccgggtaacgtacggtacgttacgggttacgtttagtcggttacggtacgttaacccgggg

SEQ ID NO: 280552 - DNA, 831 bp, Homo sapiens
  misc_feature: GYAE6OF01C3URJ.41.12.B01.1.454.CMB.1.raw
  modified_base (814)..(814): a, c, t, g, unknown or other
  misc_feature (814)..(814): n is a, c, g, or t
tcagtctatactatcacgaccggtgctcgatttagtagtgtagattcggcggggagtcagacccactcaggacacagcatggacatgagggtccccgctcagctccgtggggcctcctgctgctctggcctcccgaggcgccagatgtgccatccagatcgacccagtcctccatcctcactgtctgctatcgtggtaagggagacaggacgtaccaacctattaccgttcgggacccgggtactaacggtcggacggggtactaagttaaagaaacttcggttaacgttttacggcccggttaggttaacggtaccggaaccgtaaacggtaaaaacccggaaacgggaaacccctcccccgtagaccgtcccttccgtacttacgtcgttacgtacgtcgaccgttacctaaccttaaccggttaaaccggaacgggttcccgggttaccaacggttaccgtaaacgggttcccgacggggtccggttacggtaacggtcggtacggtacccgggtacgtaaccgtacggttacgttacctttacccaacccgtttaccctaacccgtaacccgtaatacccggaaacggttccctccgggtaacccgcgggtaccctacccgggtaattaacgggttaacttttaccgtttaaccgtaaccttttaacggtttaccgttaacgtaaccttaacgtaaacgtaccgtttaacttaacccgtttacgtacccgggtttagttaccgggttaccggacggtacgtcggtgtacgacggactaaaccggtaactaagggacgtcgtaacccggtnacccgtcgtacttaccg

SEQ ID NO: 280553 - DNA, 131 bp, Homo sapiens
  misc_feature: GYAE6OF02IVZAS.41.12.B01.1.454.CMB.1.raw
  modified_base (131)..(131): a, c, t, g, unknown or other
  misc_feature (131)..(131): n is a, c, g, or t
tcagtctatactatcacgaccggtgctcgatttagtagtgtagattccgcgggctggcaaggcgcatagcgcctgcctggtcaaggactacttccatagtatagactgagcgggctggcaaggcgcatagn

SEQ ID NO: 280554 - DNA, 204 bp, Homo sapiens
  misc_feature: GYAE6OF02FR5KR.41.12.B01.1.454.CMB.1.raw
  modified_base (196)..(204): a, c, t, g, unknown or other
  misc_feature (196)..(204): n is a, c, g, or t
tcagtctatactatcacgaccggtgctcgatttagtagtgtagattccgcgggcacgaccggtgctcgatttagtgtgagctgttccgcgggcacgaccggtgctcgatttagtgtgagtagtcccgcggaacttcacactaaatcgagcaccggtcgtgatagtatagactgagcgggctggcaaggcgcatagnnnnnnnnn

SEQ ID NO: 280555 - DNA, 236 bp, Homo sapiens
  misc_feature: GYAE6OF02G6X8B.41.12.B01.1.454.CMB.1.raw
  modified_base (216)..(236): a, c, t, g, unknown or other
  misc_feature (216)..(236): n is a, c, g, or t
tcagtctatactatcacgaccggtgctcgatttagtagtgtagatttcgggtttcgggggaagaggaagactgacggtcctcccaggagttcaggtgctgggcaccttgggcacggggagtgtgtcacaagatttgggctctggcacagcggccctgggctgcctggtcaaggctacttccagtctactgctgagcgggctggcaaggcgcatagnnnnnnnnnnnnnnnnnnnnn

SEQ ID NO: 280556 - DNA, 547 bp, Homo sapiens
  misc_feature: GYAE6OF01DUQEG.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccagcatcacctgctctggagattcattgtacaaaagcaaatatgcttattggtaccagcagaaaccaggccacggcccctgtggtggtgctatataaagacactgagacggccctcgacgggacccctggacgcgattctcgtggctccaggtcagggacaacgagtcacgttgaccatcaggtgagtcaggcagaaggacgaggctgaactattactgtcaatcagacagacagacgtagttggttacgttttcgggtttcggcggtaacgggtacaaggtccgtagacccgtcgtacggtaccacggacccgaacggccgtaccgtcccccgtcggtacccg

SEQ ID NO: 280557 - DNA, 513 bp, Homo sapiens
  misc_feature: GYAE6OF01EAKEK.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagcatcacctgctctggagattcattgtcaaagcaatatgcttattggtaccagcagaaaccaggccaggccccctgtggtggtgctatataaagacactgagaggccctcacgggacccctgagcgattctctggctccgaggtcagggacaacagtcacgttgaccatcagtggagtcaggcagaagacgaggctgactattactgtacaatcagcagacagcagtggttacgttttcgggtttcggcgggagggaccagtctggaccgtcgtaggtcacgccaagcctcgcccccgtgtacccg

SEQ ID NO: 280558 - DNA, 513 bp, Homo sapiens
  misc_feature: GYAE6OF01DD9U5.40.54.E10.1.454.CMB.1.raw
  modified_base (360)..(360): a, c, t, g, unknown or other
  misc_feature (360)..(360): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccagcatcacctgctctggagattcattgtacaaagcaaatatgcttatggtaccagcagaaaccagccaggcccctgtggtgtgctataataaagacactgagaggccctcagggacccctgagcgattctctggctcgaggtcagggacaacngtcacgttgacatcagtgagtccgaggcagaagacgaggctagactattactgtacaatcagcaagacagcgagttgttacgttttgggttcggacggacggacagcgtgaccgtctacgtacacgtacccaaggctccgccccgtggtaccc

SEQ ID NO: 280559 - DNA, 529 bp, Homo sapiens
  misc_feature: GYAE6OF01C381U.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagcatcacctgctctggagattcattgtacaaaagcaatatgcttatggtaccagcaagaaccaggccaggcccctgtggtggtgctatataaagacatgagacggccctcgacgggacccctgagcgattctctggctcgaggtcagggacaacgagtcacgttgaccatcaggtgagtccaggcagaagacgaggctagactattactagtcaatcgagtcagacacgctagtggtttacgttttcgggtttcggacggtacgggacaggctaggaccgttcgtaggtcacgtccgaacggctaccgccccgttggtaccg

SEQ ID NO: 280560 - DNA, 507 bp, Homo sapiens
  misc_feature: GYAE6OF01DQQNF.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagcatcacctgctctggagattcattgtacaaagcaatatgcttattggtaccagcagaaaccagccagcccctgtggtggtgctatataaagacactgagagccctcagggacccctgagcgattctctgctcaggtcagggacaacagtcacgttgaccatcagtgagtccaggcagaagcgaggctgactattactgtcaatcagcagacagcagtggttacgttttcgggtttcggcgggagggaccaaggctagaccgtccgtaggtcacgcccgaaggctcggcccctgggtccc

SEQ ID NO: 280561 - DNA, 549 bp, Homo sapiens
  misc_feature: GYAE6OF01CJQOE.40.54.E10.1.454.CMB.1.raw
  modified_base (470)..(470): a, c, t, g, unknown or other
  misc_feature (470)..(470): n is a, c, g, or t
tcagtctagcgactcacgaccggtgctcgatttagatcgtagcagaacacacaaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagcatcacctgctctggagattcattgtacaaagcaatatgcttattggtaccagcaagaaaccaggccacggcccctgtggtggtgctatataaagacactgagacggccctcgacgggacccctgacgcgattctctgctcgaggtcagggacaacgagtcacgtgaccatcagtgacgtcgaggcaagaagacgagctagactatactgtacaatcagacagacgagcgtaggttacggttacgttttacgggtttcggnggacgggtaccgaacgtcgtacgtacccggtaccgtaggtacgacggaccctaacggcctcccggcccccgtggtaccc

SEQ ID NO: 280562 - DNA, 681 bp, Homo sapiens
  misc_feature: GYAE6OF01C228N.40.54.E10.1.454.CMB.1.raw
  modified_base (232)..(232): a, c, t, g, unknown or other
  misc_feature (232)..(232): n is a, c, g, or t
tcagtctagcgactcacgaccggtgctcgatttagatcgtagcagaacacacaaagggggtgggtccaggaggcagaactctgggtgtctcaccatggcctggatccctctacttcctcccctcctcactctctgcacaggctctgacggccttcctatgagctgacacacgcccacccgtcggtgtcagttcgtccccgaggacaaggaccggccagcatccactgcctcngggatattcagttgtacaaagcaatatgtactttagttacggtaccagacaacgaaaccgacggaccgacggccccgtggtgggttggtagtactaataagtaaacgacacgtagacgtacggccctacggacgggaccctgacgtcgtacttcgtcgtcggtcgtaccgacgggtacgagggaacctaacgtacgtacctacggttacgaccctagtacgtaggtacggacgtaccgaaggacgaacggaaggtacggacgtactacggtaacttagttacgtacgtacaagtacgagacacgaagacgtacgttacggtttacggtttacgggtttttcgggttaccggggacgggtacgggtaaccgacggtcgtacggtacccgtacggttaccgtaccgaacccggtccggtaacgcccggtccccgccccgttcggttacccg

SEQ ID NO: 280563 - DNA, 605 bp, Homo sapiens
  misc_feature: GYAE6OF01DJZQ7.40.54.E10.1.454.CMB.1.raw
  modified_base (372)..(372): a, c, t, g, unknown or other
  misc_feature (372)..(372): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccagcatcacctgctctggagattcattgtacaaagcaatatgtcttattggtaccagacaagaaaccacggccacggccccctggtggtggtgctatataaagacactgagacggccctcgacgggacccctgacgcgtattctctggctcgaggtcagggacaacngtactacgttacgaccatcagtggtacgtccgaggacaaggaaaggtacggaggctaggacttactttacgtagtacaatccaagtcaacgacgacgtagtacggttcgggttttacgtttttcggggtttaccgggacggggtacgggtaaccgaaggtccgtaggtacccggttaccgtacggtccgaacggtccctaacgggtcctcccggtccccccgtcgggttaccc

SEQ ID NO: 280564 - DNA, 705 bp, Homo sapiens
  misc_feature: GYAE6OF01DBQ3Q.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccagcatcacctgctctggagtacttcatttgtaccaaaagccaaattatgtactttagttggtaccagcaagaaaccaggaccacggtccccctggtggtggtgacttataagtaaaagacctatgaagacggccctacgaaccgggtacccctaggacgacgtacttcgtacgtcggtcctaccgagggttccgaaggggaccaaacgtacggtactaaccgttcgaaccaacgttaccgaaggttcgggaacgtacccgaagggtacaaaggaaacggacggaacgggcgttaacgtaaccttaagttttacctaggttactaaagtaccgtaacgacgaacgaaccgtacggacgtaagggtttaccgggttttacggttttttaccggggtttcgggaaccggggtaccgggaaccgtaacgccgttacggtacccggttcgtacggtccgaacgtcccggaaacggcccgttcccgtcccccgttgttacccg

SEQ ID NO: 280565 - DNA, 740 bp, Homo sapiens
  misc_feature: GYAE6OF01DJUVX.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttcctcccctcctcactctctgcacaggctctgacggcctcctatgagctgacacacgcccacccgtcggtgtcacgtcgtccccgaggacaggaccggccagcactcacctgcctcgtaggagtacttctatttcggtaacaaacgtcaaattacgttcgtacgtttagttacggtaccgaagtacaacggaaaaccgcggaccgaccggtccccgttggtcggtggtcgtacttaagtaagtaaacgacacgtaggacggaccgcccgtacgaccggtacccgtagacgtcgtacgttctcgtcgcgtaccgaggtacgacggaacaacgtacgtacgtacggttacgaacctacgtacgaggtacggtacgtaccgaaggacgaacggaaacggacggtacgggacgtacgtaaccgttagttaccgtacggtactaagtacgtagacgtaagacgtaacggacgtttacggtttacgggttttaccgggttttacggggttaccgggtaaccggggtaccggtaaccgtaacgggtcccgttacgggtaacccggttcccggtacgggtacccaacccggttacccggaacggttcccgacccggttccccggtcggtacccg

SEQ ID NO: 280566 - DNA, 683 bp, Homo sapiens
  misc_feature: GYAE6OF01DCELN.40.54.E10.1.454.CMB.1.raw
  modified_base (228)..(228): a, c, t, g, unknown or other
  misc_feature (228)..(228): n is a, c, g, or t
  modified_base (476)..(476): a, c, t, g, unknown or other
  misc_feature (476)..(476): n is a, c, g, or t
tcagtctagcgactcacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccagcatcacctgctctggatnttcatttgacaaagcaatatgtacttagttcggtaaccagacaacgaaaccgtacggacccgacggccccgttggtgggtggtcgtacttaataaagtaaacgactacgtagacgtaccggccctacgaaccgggtcccctagacgtccgtattcgtcgtcggtcctacgacggtcgaaggaccaacgagtcctaacggttacaccgtagtcgaggtggtacgtacgaaggcaaggaaacgcggacgntacgtactagttacgtataccaatcgacgacaagacgtcgtacgttacgggtttacggtttaccgggtttttacggggttacgggacggggtaacggtaaccgaagggtaccgtaccgggttaaaccccggttccggttaacgggtacccgtacccgggtaaccccgaacgggttcccgaccccgggttaccccgtcgggttacccc

SEQ ID NO: 280567 - DNA, 658 bp, Homo sapiens
  misc_feature: GYAE6OF01EN0HY.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacaggacggccagcatcacctgctctggatattcattgtacaaagctaatatgtacttagttcggtaccagacaagaaaccaggaccacggtcccccgttaggtggtggtgtccttaataataaagacactagagacgccctcgacgggtaccctggacgacgtattccgtcgtcggtcctcgacggtcgacgggaccaacgtagtctaacggttcgaccgtatcgaggtcgacgtacccaggccgaaggaaacgacgagggtctaggtaactttacttaccgttacgtacaacttcaacgacgaaacgtcgaacgtacgttagggtttacggttacgtttttccgggggtttacgggaccgggtaacgggtaacccgtaaggtacccggttcggaacccgttccggtaacggtcgtaaccggtccccggaacgtcccgttcccggtccccgttcgtacccg

SEQ ID NO: 280568 - DNA, 804 bp, Homo sapiens
  misc_feature: GYAE6OF01C51LI.40.54.E10.1.454.CMB.1.raw
  modified_base (141)..(141): a, c, t, g, unknown or other
  misc_feature (141)..(141): n is a, c, g, or t
  modified_base (340)..(340): a, c, t, g, unknown or other
  misc_feature (340)..(340): n is a, c, g, or t
tcagtctagcgactcacgaccggtgctcgatttagatcgtagcagaacacacaaagggggtgggtccaggaggcagaactctgggtgtctcaccatggcctggatccctctactttcctccccctcctcactctctgcacnggctctggacggcctcctatgagctgacacagcccacccgtggtgtcagtcgtccccaggacaggaccggccagcaactccaccgttgcctcgtagggatatttcatttcgacaaagcaaatatgtactttagttcggtaaccaggacaacgaaaccgacggccgacggtccccgtggttgggtggtgtacgtaataanaaagctagtcggaagtccggacctaccggaaccgggtacccctggaacggcgtacgttcttcgtcggtccctaccgtagggtaccgtaacggggaaccaaccgtacggttaccgtacggttacgaacccgtaagttacccggtagggtacgggtacgttaacccggaggggccgaaacgggaaacgggtacggggaacgggtcgttaacgtaaccgttttaagttaaccggttcgtactaaacttcggaaacggactaacggtaaccgaggttaaccgtacgggttttacggggtttttacccgggttttttcgggggttttacccggggacggggtaaaccgggtccgtaaacgggtcccgtacccggggttaccccgttaccgggttacggggttacccgaacccggggtaacccgtaaccgggttcccgggttaccccggtcccccgttcgggttaccccg

SEQ ID NO: 280569 - DNA, 698 bp, Homo sapiens
  misc_feature: GYAE6OF01APMOT.40.54.E10.1.454.CMB.1.raw
  modified_base (183)..(183): a, c, t, g, unknown or other
  misc_feature (183)..(183): n is a, c, g, or t
  modified_base (225)..(225): a, c, t, g, unknown or other
  misc_feature (225)..(225): n is a, c, g, or t
  modified_base (452)..(452): a, c, t, g, unknown or other
  misc_feature (452)..(452): n is a, c, g, or t
tcagtctagcgactcacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagcccaccctcggtntcagtcgtccccgaggacagacggccagcatcacctgctcgnggagtattcattgtacaaagctaatatgtactttatcggtaccagtcaacgaaaccgaggtccaacggtccccctgggttacgggttggtagtcgtaattaacgtaaaaggacctacgtggaaggaccggtaccccgtacggaaccggggtacccctagggaacgtcgtaactttccgtcgtcggcctccgaggtcgaagggaccaacgtagtccacggttgaaccngtacgacggtgacgtccgaggtacaaggtaacgacgggagtaccgtacgaacttaagttaccgtgtaacctaagaccgtagaccgtaacggaactacggtaccggtaaggttaccgggtttaccggtttttcggggttacgggacgggttaaccggaccgtaaggtcccggtacggacccggttccgtaagggtcccaaccggtacccggtagggaccccttccgggcccccgtttcgggtacccc

SEQ ID NO: 280570 - DNA, 665 bp, Homo sapiens
  misc_feature: GYAE6OF01C2QLO.40.54.E10.1.454.CMB.1.raw
  modified_base (273)..(273): a, c, t, g, unknown or other
  misc_feature (273)..(273): n is a, c, g, or t
  modified_base (519)..(519): a, c, t, g, unknown or other
  misc_feature (519)..(519): n is a, c, g, or t
  modified_base (659)..(659): a, c, t, g, unknown or other
  misc_feature (659)..(659): n is a, c, g, or t
tcagtctagcgactcacgaccggtgctcgatttagatcgtagcagaacacacgaaagggggtgggtccaggaggcagaactctgggtgtctcaccatggcctggatccctctacttcctccccctcctcacctctctgcacaggctctggacggccttcctatgacgctgaccacacgcccacccgtggttgtacgagttcgtccccgaggacacggaccggccaagccatcacctgcctcgtaggatattctattgacaaagtctaatagtntacttagttcggaaccacgacaacgaaccgaggtacccgacggtcccgtgggtacggtagtcgtacgtaataacgtaagactacgtaggacgacggtcccgtacggacccggaccctaggacacgtacttcgtacgtcggctaccgaggtacgacggtacacgtagtccgagttacgacatacgaggtcgacgtacgaggacgaacgtagaggcgtacgtatactacgttatacggaataccgtanacgaccgaagaaccgtgacggttaacgttttcgggttaccggttttccggggttagggaccggtacgggtaacctacgggtcgtacgtaaaccgttccgaacggtcaaccgacccggttagccccgaccgtccccggttntacccg

SEQ ID NO: 280571 - DNA, 573 bp, Homo sapiens
  misc_feature: GYAE6OF01B5E1W.40.54.E10.1.454.CMB.1.raw
  modified_base (490)..(490): a, c, t, g, unknown or other
  misc_feature (490)..(490): n is a, c, g, or t
tcagtctagcgactcacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagcccacccgtcggtgtcagtcgtccccaggacaggacggccagcatccacctgctcgtggatattcattgacaaagctaatatgcttagttggtacctagcaacgaaaccgacggccgacggcccccgtggtacgggttgggtgtacctaataagtaaagaccactggagacggccctacgaccgggaccctggacgcgtacttctacgtggactccgaggtacgagggaccaacgtagtacctacggttacacctatcgaggtggacgtccgaggacaagaaggacgaggctagacttatactgactaatcagacagacngtatagttgttacggtttcgggtcggaggacggactagctcggaccgtcgaggtacacgccgacgtgcccgtcccgtcgtacc

SEQ ID NO: 280572 - DNA, 659 bp, Homo sapiens
  misc_feature: GYAE6OF01BW64U.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctcccctcctcactctctgcacaggctctgaggcctctatgagctgacacacgcccacccgtcggtgtcagtcgtcccgaggacaggacggccagcatcacctgctcgtggagtacttctattggtacaaagtactaattacttgtacctttagttcggtaacagacaacgaaaccgcggcccgacggtccccgttggtcgggtggtcgtacgtaataactaaacggactacgtaggaacggaccggtccccgtacggaaccgggtacccctaggacgtaccgtaatttcctcgtcggccttaccgaggtcgaacgggaacacgacgtctacgttcgaactagcgtagtgacgtacgaggacaaggaacgagacgctagacttatactgtacaactcgacacgagactcgagttagttacggtttacggtttacgggttcgggaaccggtacggtaacgacggtcgtacgggtaacccgttcgggtacggttaccgaaccggtacccaacgggtcccgttcccggtcccccggttgtacccccg

SEQ ID NO: 280573 - DNA, 672 bp, Homo sapiens
  misc_feature: GYAE6OF01BTJYN.40.54.E10.1.454.CMB.1.raw
  modified_base (543)..(543): a, c, t, g, unknown or other
  misc_feature (543)..(543): n is a, c, g, or t
tcagtctagcgactcacgaccggtgctcgatttagatcgtagcagaacacacaaagggggtgggtccaggaggcagaactctgggtgtctcaccatggcctggatccctctacttcctccccctcctcactctctgcacaggctctgaggccctcctatgagctgacacacgcccacccgtcggtgtcagtcgtcccccgaggacaggaccggccagcatccacctgctcgtggagtacttcattgtacaaagctaatatgtactttagttcggtaccagacaacgaaaccgacggccgacggccccgtggtgggtggtcgtactaataagtaaacgactacgtaggagaccggtccccgtacggaaccgggtacccccgtggacggtacgtactttcccgtacgtcggtacctacccggacgggtaccggaacgggtaaccaacgtaacgtccgtacggttacgaacctagtacgagggtcggaccgtccgaggacgtaaggaacggacggacgcgtagaccttagttacgtcgtactaacncgaagacaacgacgagacgtacggttcggttacgttttcggggtacggacgggtacggacgtacggcgttacgacccggtcgtacggtaccgacgacccggacggcccttccggccccgtcggtacccg

SEQ ID NO: 280574 - DNA, 684 bp, Homo sapiens
  misc_feature: GYAE6OF01AOJ5R.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccagcatcacctgctctggagattcattgtacaaagctaaatatgtactttagttcggtaaccagcaacgaaacccgaggacccgaacggtcccccttggttgggtggtcgtactaactaataaacgactacgtgaggacggccctcggacgggaccctgacgcgtattccgtcgtcggctccgtaggtcgacgggacaacgtagtcgtacgtacgactatacgagtcggacgtaccgaggacgaaggtaggaacggacggtacgtagtaacttagttacgtcggtaactaacgtacgaagtaaccgaaggaacgtacggaccgtttaagggttcgggttttaccggttttcgggggtttccggacggggtaccggtaacggaacggttccggtaccggtacccggttaccggtacggtacccgtaaccggtaccccggtacggtacccgttcccggtccccccggttcggttaccccg

SEQ ID NO: 280575 - DNA, 877 bp, Homo sapiens
  misc_feature: GYAE6OF01BOAK3.40.54.E10.1.454.CMB.1.raw
tcagtctagcgactcacgaccggtgctcgatttagatcgtagcagaacacacaaagggggtgggtccaggaggcagaactctgggtgtctcaccagtggcctggactccctctacttcctccccctctcactctctgcacgaggctcgtgacggcccttctagtgagctgacaccagcccacccgtggtgtcagtccgtcccgaaggacacggaccggccagtcatccacctgctacgtggatacttcgactgtaacaagctagtatgtattacgtacgtacgacgacaacgtaacgacggcctaccggtcccgtaggtcgggttggacgtaccgttaattaacgtaaaacggacctacgtaacgggtacgaacccggtcccctacggaacccgggtacccgtcggtaacggcttacgttaccgtcgtaccggtactacggtacggtacggaaccggtacaacgtcggtaccgtaccggttacgtaacccgtagtacgtacgggacggttaccgtaccgggaaacgggacgaaaaccgggttaacgggaaccgggtaacggggtacctttaaaccggggtaaacgttttaaccgtttaacggttaccgtaaaccgttaacgttaccccgaaagggttaccccaaagggttacccgggaaacggttccgttaaaccggggggtttcggtttttaaccgggggtttttacccgggggttaccgggaaacgggtttaacccgggtaaaccggttacggggttacccggtaacccgggttaacccccgggttacggttaacccggggtaccaaaccgggtcccccggttaaacgggttccccggtaaacccccgggtcccccggtttaaacggtccccccg

SEQ ID NO: 280576 - DNA, 808 bp, Homo sapiens
  misc_feature: GYAE6OF01BOGRP.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttcctccccctcctcactctctgcacaggctctgacggtcctcctatgacgctagacacgacgtccctacccgtggttcgacctacggtccgtaccccggaggaccgacggaccggacccgagacctactaccaccgttgtccgttcgtaggtacgttacctttcgtaacgttttacgtaacgaaaacgtaccttaattaagttccggttacttttacggttaccgggttaaccgaacggacgaaaccgtaaacccgacggaccccggaccggtacccccgttaggttacgggttacggtacgtaaccgttaataagtaaaacgtaccgtaaccgtaggacgaccggtaccccgtacggtaaccgggtaccctaggacggtacgtacgttccgtaccgtcggtccgtacggacggtaccgacggaacaacgtcgtaccgtacgtccgactacgtacgtaggtacggacgtaccgacggtacgagtaacggagtacgacgtacgtactttacgtaacttcgaactacgacgtaacgacgtacgtaacgagtacgtttacgggtttgtttaccgggtttccggggtacgggtaccgggtaacgggtaccctacgggccttacgggttacccgtacggtccgttacccgaacggtccccggtacggaccccggttccccggccggtcccgttacccgg

SEQ ID NO: 280577 - DNA, 928 bp, Homo sapiens
  misc_feature: GYAE6OF01B2VM6.40.54.E10.1.454.CMB.1.raw
tcagtctagcgactcacgaccggtgctcgatttagatcgtagcagaacacacgaaagggggtggtccaggaggcagaactcgtgggtgtcctcaccatcggcctggactccctctacttcctccccctctcactctctgccacgaggctacgtgacggtccttcgtactgacgctacgacacacggcccctaccgttcgggttcgtaccgtacggttccgtacccccggaagggaaccacgggacccggaccgtaacggcctactccgacccgttgccgttcgtagggacttactttactagtttacggaacaaaaggacttaaagttacgttcggtacgttttaacggttaaccggtaaccgaacgtacgaaacggaaacccgacgggtacccggaccggtccccgtgggttacggggttacggttacgtacgttaaacgtttaaacggaaacggtaccgttaacggaacggtaaccgggtacccggtaccccggtaaccggaccggggttaaccccgtaggtaccggtccgtttaaccgttccgttcgggtcccggttacccgtaccgggtaaccgggtaaccggaacggaaacccgtaaacgtaccggttaccggtaaccggtttaccaaccgttacgtaccgggtaacgggttacggaccgttaccgggaacgggaacgaaacgggaaccggaaggggtcggttaaccctaggttaaacctttacggttaaccgttacgtaacggaactaccggacgaacggtacgacggttacccgtaagggtttaccggttttacgggttttacgggtttaccggggttcgggaacgggttaccggaccgtaacgggtctaccggaccggttaccggtacgtacccgaccgggtaacccgtcggtacccgccccggttcgttcggtaacccc

SEQ ID NO: 280578 - DNA, 537 bp, Homo sapiens
  misc_feature: GYAE6OF02HTPAE.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtacaaagcaatatgcttattggtaccagcagaaaccaggccaggcccctgtggtggtgctatataaagacactgagaggccctcgacggggacccctgagcgtattctctggcctcgaggtcgagggacaacagtcacgttgaccatcagtggagtccaggcagaagacgaggctagacttattacgtgtacaatcagcagacgagctaggttggttacgttttcggggttttcggcgggtagggaccaggctacggtacccgtcgtacggtcacggcccaaggcctacggcccccgtggtaccc

SEQ ID NO: 280579 - DNA, 797 bp, Homo sapiens
  misc_feature: GYAE6OF02F628Z.40.54.E10.1.454.CMB.1.raw
  modified_base (235)..(235): a, c, t, g, unknown or other
  misc_feature (235)..(235): n is a, c, g, or t
tcagtctagcgactcacgaccggtgctcgatttagatcgtagcagaacacacaaaggggtggtccaggaggcagaactctgggtgtctcaccatggcctggatccctctacttctccccctcctcacctctctgcacaggctctgacggccctcctatgagctgacacagcccaaccctcggtgtccagtcgtcccccaggaccaggaccggccagcatccacctgctctggganacttcattgtaccaaagcaatactgcttattcggtaccagaccaacgaacccaggcccacggtcccctggtcggtgtcgactataactaaacgacacgtgacgacggcccctcgacgggacccctggacgcgtacttccgtcgtcggtcctacccgaacggtccgaacggggtaaccaaccgtaccgtaccgtaccggtttccgaaccgtaactccgaacggtcgggtaaccggtacccggacgggtaccgaacgggtaaaacggaccgggtaacgggtccgttacgtaaccgtttaacgtttaacccttggttaccctaaacgtaccgaacggtaccaacggtaaccgaacggtaccgttaaccgggttacggtttaacccgggtttttaccgggggttttacccgggggaaccgggggtaaccggggtaacccgtaacgggtacccggttaccgggtaacccccggtttacccggttaaccgggttaccccgaaccgggtacccccggtaaaccggggtcccctaccccggggtacccccccggttaccgggttaccccg

SEQ ID NO: 280580 - DNA, 556 bp, Homo sapiens
  misc_feature: GYAE6OF02HJV0G.40.54.E10.1.454.CMB.1.raw
  modified_base (225)..(225): a, c, t, g, unknown or other
  misc_feature (225)..(225): n is a, c, g, or t
  modified_base (372)..(372): a, c, t, g, unknown or other
  misc_feature (372)..(372): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccagcatcacctgctctgganattcattgtacaaagcaatatgcttattggtaccagcaacgaaacaggccaggccctgtggtggtgctataataaagacacgtgagacggccctcgacgggtacccctgacgcgattctcgtcggcctcgaggtcgagggacaacgngtacacgttcgaccatcagtggacgtccgagacaagaacggacgaggctagtactattacgngtacatgancagacngtacgagttggtttacgtttcgggtttcggcggtacggacaagtcgtcgtaccgttaccgtaggaccgacgacccgaaggtccgtcccggtaccccgtcggtacccg

SEQ ID NO: 280581 - DNA, 514 bp, Homo sapiens
  misc_feature: GYAE6OF02FXRS0.40.54.E10.1.454.CMB.1.raw
  modified_base (225)..(225): a, c, t, g, unknown or other
  misc_feature (225)..(225): n is a, c, g, or t
  modified_base (412)..(412): a, c, t, g, unknown or other
  misc_feature (412)..(412): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagcatcacctgctctgganattcattgcaaagcaatatgcttattggtaccagcagaaacccaggccaggcccctgtggtggtgctatataaagacactgagaggccctcgagggacccctgacgcgattctctggctccgaggtcagggacaacagtcacgttgaccatcagtggatccgagcagaagacgagctgactattacngtcaatcagcagacagcagtgtacgttttcgggtttcgcggtaggactaggctcggaccgtccgtaggtacacgcccgaaggccgtcgcccccgtgtacccg

SEQ ID NO: 280582 - DNA, 556 bp, Homo sapiens
  misc_feature: GYAE6OF02HPYCI.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagcatcacctgctctggagattcattgtcaaagcaaatatgctttattggtaccagcaagaaaccaggccaggcccctgtggtggtgctataataaagacactgagacggccctcgacgggcccctagagcgattctcgtggcctccgaggtccaaggggacaacgtagtcctacgtttcgaaccatcgaggtaggtacgtccgaggacaagaaggacgaggctagactattactgtacaatcagacagacagcgtagtcggttacgtttcgggttttcgggacggtacgggacaggcgtcgaccgtcgtaggtcgacgcccgaggtcctaccggtcccccgtgtacccg

SEQ ID NO: 280583 - DNA, 589 bp, Homo sapiens
  misc_feature: GYAE6OF02GF5UF.40.54.E10.1.454.CMB.1.raw
  modified_base (226)..(226): a, c, t, g, unknown or other
  misc_feature (226)..(226): n is a, c, g, or t
  modified_base (498)..(498): a, c, t, g, unknown or other
  misc_feature (498)..(498): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccagcatcacctgctcgtgganattcattgtacaaagcaatatgcttattcggtaccagcaagaaaccaggccacggcccctgtggtggtgctatataaagactactgagacgccctcgacggacccctgacgcgtacgttctcgtcggcctccgaggtcgagggaacaacgagtcacgttagaccatacaggtgacgtaccgagacaggaacgacgagcttagacttattacgtagtaccaagtacagacgagacagacgtagttcggtttaccgttttcggggtttaccggngggtacgggaccgtaaggtccgttaacggtacccgtacgtacggtacgaccggacccgtaacggtccctcccggtaccccgttcggtaccc

SEQ ID NO: 280584 - DNA, 607 bp, Homo sapiens
  misc_feature: GYAE6OF02GE8CG.40.54.E10.1.454.CMB.1.raw
  modified_base (142)..(142): a, c, t, g, unknown or other
  misc_feature (142)..(142): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagtctagcgactcacgaccggtgctcgatttagatcgtagcagaacacacaaaaggggggtgggtccaggaggcagaactctgggtgtctcaccatggcctggatccctctacttcctccccctcctcactctctgcacnggctctgaggcctcctatgagctgacacagcccaccctcggtgtcagtcgtccccaggacagacggccagcatcacctgctctggagattcattgacaaagcaatatgctttattcggtaccagcaagaaaccaggccacggcccctgtgggtggtgctaatataaagacactgaggacggccctcgacggacccctgacgcgtattctcgtcggctcgaggtcagggacacgagtcacgtcgacatcaggtggacgtccgaggcaagaaggacggagcgttagaccttattacgtntacaactcaagtccaagacnggtacgtaagttcgggtttaccgtttttcgggggttccggagggtacgggtacccgaggtccgttacggtaaccccggttcggtaacggttcccgaaccggtccccggtaacgtcccgggtacccgtcccccggttacggtacccccg

SEQ ID NO: 280585 - DNA, 770 bp, Homo sapiens
  misc_feature: GYAE6OF02JBDRD.40.54.E10.1.454.CMB.1.raw
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccacccgtcggtgtcagtcgtaccccgaggacagacggccagcatccacctgcttgcggatacttcattgacaaagcaatatgtactttagttacggtaccagacgaacgaaaccgaggaccacggtccccgttggttgggtacggttcgactaattaaagtaaacggaccttacgacgacggtaacggcccttacggaacggggtacccctgacgaccgtagttccgtcgtcggtaccttaccggtacgggtaccgaacggggaacctaaacgtacggttaccgtaaccgggtttacaacccggtattccgggtaaacggtcgggtaaacccggttaccgaacgggtaccgtaaagggaaaccgggtacggtaacggtcgttaacggttaaactttaacggtttacgttacggaaacttaacgtacaacggtccgaaacggacaacggtcgttaacggggtttcggtttttaccggttttacgggggttccggaacggggttacgaaccggtaaggtccgggttacgtacccggttaccggtaaccgttcgaacccggtaccgtagggttcccctacccggtacccggtacgtaccccg

SEQ ID NO: 280586 - DNA, 735 bp, Homo sapiens
  misc_feature: GYAE6OF02GOIQ8.40.54.E10.1.454.CMB.1.raw
  modified_base (504)..(504): a, c, t, g, unknown or other
  misc_feature (504)..(504): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccgaggacaggacggcagcatcacctgctctggagattcattgtacaaagtacaatatcgtctttagttacggtacagacaacgaaaccgacggacccgacggtaccccttgggttgggtgggtcgtacttaagtaataaacgacaacgtgaggaccgccctacggaccggacccgtggacgtcgttattttcgtcgtccgtccgaggtacgagggtaaccaaacgtaccggtaccgtaacggttaccgaacctcgtaacgtacgggtcgggtaacgtacccggaaggaccgtaaggaaacgggtaccggnggtactaacgttaactttaacgtttacgtaaggtactaaacgtacgaagtaccaaaggacctacggagttacgggtttacggttttaaacccgggtttttcgggggttaaccgggacgggttaaccgggacccgtaaggtcccggtaacggtaccccgtttacgggaaccggttcgaacccggccgtaaccggggtccctcccggtacccccggttacggtacctaccccg

SEQ ID NO: 280587 - DNA, 685 bp, Homo sapiens
  misc_feature: GYAE6OF02JTEBO.40.54.E10.1.454.CMB.1.raw
  modified_base (137)..(137): a, c, t, g, unknown or other
  misc_feature (137)..(137): n is a, c, g, or t
tcagtctagcgactcacgaccggtgctcgatttagatcgtagcagaacacacaaagggggtgggtccaggaggcagaactctgggtgtctcaccatggcctggatccctctacttctcccctctcactctctgcacnggctctgacggcctcctatgagctgacctacagcccacccgtggtgtcaggttctaccccgaagggacaggacggtccagtcaatccacctgcctcgtggatacttcattgtacaaagtctaatatgacttagttcggtaccagctaaacgaaccaggccacggccccgtggttcgggtagggtcacgtttaaacgtaagtaaacgaccgtaacgttggaacggaaccggcccgttaccggaaccgggttaaccccgaggtacgtccgtaacgtttccgttcgtacgggtcctacccggaggttaccgaacggaaccgtaaacggtacgttacgtaccgtttaacacccgtacgtacgtacggttacgacggtaccgaggtacgagtaaacgcggacggtatcgtaaccttattaccgtgtacaagtcgacgactagaacagtcgttagttacggttacgtttcggggtttacggacggtcggtacgtaacggtcgtaaccgtaccgtgtaacggtcgacgtccaggcctaccggtccctacggtccc

SEQ ID NO: 280588 - DNA, 635 bp, Homo sapiens
  misc_feature: GYAE6OF02HXMKO.40.54.E10.1.454.CMB.1.raw
  modified_base (180)..(180): a, c, t, g, unknown or other
  misc_feature (180)..(180): n is a, c, g, or t
  modified_base (222)..(222): a, c, t, g, unknown or other
  misc_feature (222)..(222): n is a, c, g, or t
  modified_base (329)..(329): a, c, t, g, unknown or other
  misc_feature (329)..(329): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccacctcggtntcagtcgcccaggacagacggccagcatcacctgctctgganattcattgacaaagcaatatgcttattggtaccagcagaaaccaggccacggtccccgtgtcggtggtgctaataataaagacactgagacgcctcgacgggacccngacgcgattcctctggcctacccgaggttaccgaaggggaacctaaagaggtacctacggttacgaacgtaactcgtaaggttagggaacgttaccgaagggtaccgaaggaaaggaaccgggaggtaccttaggaaaccttaattaaccttacgtactaaacttacgacgtaacagaccgtagacggtagttaggtttaacgttttcggggttacgggacggacgggtaaccgtaacggcgtccggtaccgtccgttagggcgtaccggactaaccggtccgtaccgtcccccgtaggtaacccc

SEQ ID NO: 280589 - DNA, 725 bp, Homo sapiens
  misc_feature: GYAE6OF02J0EHQ.40.54.E10.1.454.CMB.1.raw
  modified_base (142)..(142): a, c, t, g, unknown or other
  misc_feature (142)..(142): n is a, c, g, or t
  modified_base (309)..(309): a, c, t, g, unknown or other
  misc_feature (309)..(309): n is a, c, g, or t
  modified_base (400)..(400): a, c, t, g, unknown or other
  misc_feature (400)..(400): n is a, c, g, or t
  modified_base (581)..(581): a, c, t, g, unknown or other
  misc_feature (581)..(581): n is a, c, g, or t
tcagtctagcgactcacgaccggtgctcgatttagatcgtagcagaacgacgacaaagggggtgggtccaggaggcagaactctgggtgtctcaccatggcctggactccctctacttcctcccctcctcactctctgcacnggctctgacggcctcctatgagctgacacacgcccaccctcggtgtccagtcgtccccgaggaccaggacggccagcactccacccgtgctcgtggacgtattccatttggaccaaaagtctaaatatgtcctttagttcggtaccaggtaccaacggaaaacccgnggtacccgaccgggccccttgggtcggtggtcactaagtaagtaaaacgaccgagtagaacgaccgggcctaccgggaaccggggtacccnggtaagccggtacttaccgtcgtcggtcctaccggaggtaccggaacggtaaccgaaacgtggttacccgaacggtttacggaaccctaagtcgaacgggttcgggaacggttcccgaaggggaccaagggtaacgacggtacggtctacgaactttacgacgtctacgaacgtcgacganacgacgaacgtaccgtagggttacggttttacggttttccggggttcgggccgggttacgggaccgttaacggcgttaccggtaccgtaccggtaggtaaccgacccggtccgaacgggtccttaccccggcccgttagtaccg

SEQ ID NO: 280590 - DNA, 611 bp, Homo sapiens
  misc_feature: GYAE6OF02F1YRU.40.54.E10.1.454.CMB.1.raw
  modified_base (143)..(143): a, c, t, g, unknown or other
  misc_feature (143)..(143): n is a, c, g, or t
  modified_base (231)..(231): a, c, t, g, unknown or other
  misc_feature (231)..(231): n is a, c, g, or t
  modified_base (253)..(254): a, c, t, g, unknown or other
  misc_feature (253)..(254): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagtctagcgactcacgaccggtgctcgatttagatcgtagcagaacacacaaagggggtggtccaggaggcagaactctgggtgtctcaccatggcctggatccctctacttcctccccctctcactctctgcacaggctntgagcctctatgagctgacacagccctacccgttggtctacgagttcgtccccgaggacaggtaccggccagcatcccaccgtgctcnggtacattcattgacaagcatnntcttntgtacagacagaacngcncgtcctgtggtgnactanataanctatgagacgcctacgacgtccagcgtcgtagtctgtcgcctacgtaggtacaagggacacggtctacgtacgtanaccngtagtacgttggacgtcaaggtcgtaacggaacgtacgagtacggtacgtaacttaggttactacgtcaacgtccgtagacgtaacgacgagtacgtagggtttaccgtttacggttttccgggttacggaccggttaacggcgaccggtttacggaccggtttacccgtaagggttccgaaccggttccgaacgggttaccgaccgtcccggttacccgtcggttaaccg

SEQ ID NO: 280591 - DNA, 881 bp, Homo sapiens
  misc_feature: GYAE6OF02J3H67.40.54.E10.1.454.CMB.1.raw
  modified_base (111)..(111): a, c, t, g, unknown or other
  misc_feature (111)..(111): n is a, c, g, or t
  modified_base (205)..(205): a, c, t, g, unknown or other
  misc_feature (205)..(205): n is a, c, g, or t
  modified_base (634)..(634): a, c, t, g, unknown or other
  misc_feature (634)..(634): n is a, c, g, or t
  modified_base (703)..(703): a, c, t, g, unknown or other
  misc_feature (703)..(703): n is a, c, g, or t
  modified_base (718)..(718): a, c, t, g, unknown or other
  misc_feature (718)..(718): n is a, c, g, or t
tcagtctagcgactcacgaccggtgctcgatttagatcgtagcagaacacacaaagggggtgggtccagggaggcagaactctgggtgtctcaccatggcctggatccctntactctcccctctcactctctgccacgaggtctcgtagacggtcccttacctagtcgacgtcctagacctacgacgtccccgtacccgtgggtntaccacggttcctcccggaggacctaggaccggaccacggactacgtaccctaccgtcggtccttacggttagggacttacctacgttacgttacggaacgaaaaccgttctaaagtcgttccgttacgtttacggttaccgaccgacgtaacgaaaccggttaaacccgcggtccccggtaccggtttcccggtaggttacggtacggaccttaacttaaggtaaacgaaccgttaccgagggttacggaacccggaccggttccgacccgggaccccggggtttaccagggtcctaaccgtttccgtccgtttccggaaccgggtccggaaaccgggttcgggaaaccggtaataaccgggtaaacgttccgtacccggtacgggttaacaccggtacgtagaccgggttacgaccggttaaccggnggtaacccgggtaaggtacggggccgtacgtaacttaccgttacgaccgttacgactcgaagtacgganaccggtagtacccgngggtttacgttacggttttaccggttcgggggtactaccggggtaaccgactttacgggtacccttacgggacccgttacgggtaaccgttacccggaccggggtacccgttacccgggccccgggtttcccctacccgggttacgttacccgttaaccccgg

SEQ ID NO: 280592 - DNA, 558 bp, Homo sapiens
  misc_feature: GYAE6OF02I1M9D.40.54.E10.1.454.CMB.1.raw
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
tcagtctagcgactcacgaccggtgctcgatttagatcgtagcagaacacacaaagggggtgggtccaggaggcagaactctgggtgtctcaccatggcctggatccctctacttctccccctcctcactctctgcacaggctctgagcctcctatgagctgacacagccaccctggtcgtcagtcgtccccaggacagacggccagcatccacctgctctgganattcattgtacaaagcaatatgactttattggtaccagcaagaaacccnggaccacggcccctgtggtggtnctatataaagcatgagacggccctcgacggaccctgagcgtaatctcgtaggcctcaggtcaggacaacgagtcacgttcgacatcaggngacgtcaggcagaacggacgagngtaacgcttaatacttagtaccaatcgtaacgcaacgtacaagcgaagtttcggttacgttttcggggttcggacgggtacggacgaacgtcgttacggaaccgtccgttagccgtagacccgtaacggcctcggtccccgtgtaccc

SEQ ID NO: 280593 - DNA, 408 bp, Homo sapiens
  misc_feature: GYAE6OF01BXCOV.47.2.A02.1.454.CMB.1.raw
  modified_base (394)..(394): a, c, t, g, unknown or other
  misc_feature (394)..(394): n is a, c, g, or t
  modified_base (400)..(408): a, c, t, g, unknown or other
  misc_feature (400)..(408): n is a, c, g, or t
tcagagctcacgtacacgaccggtgctcgatttagactcatctacaggggaaagagccaccatctcctgtagggccggtcagagtattagcagcaacttagcctggtaccagcagaaacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgactgtggctgcaccatctgtcttcatcttcccgcatctgatacgtgagctctgagcgggctggcaaggcncatagnnnnnnnnn

SEQ ID NO: 280594 - DNA, 716 bp, Homo sapiens
  misc_feature: GYAE6OF01APL1S.47.2.A02.1.454.CMB.1.raw
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
tcagagctcacgtacacgaccggtgctcgatttagactcatctacaggggtaaagggggtctgagagaggagcccagccctgggattttcaggtgttttcagtttggtgatcaggactgaaccggagagaactcaccatggagtttgggctgagcgtggcgtcttacgtgtcggcttttttaaaaggngtccagtgtcgaggtgctaactgttggagtctggggganacttaggtacacccgtggggggtccctgacgactctcctgtcgcagcctctggactcaccttagcaactntagtcatggctggtccgccagggcctccggggaaggcctggacgtgggtctccgaggcagttcgggtggtagttggtggccggtagggtaccacgtattaacggtaaaagtcccctaggccgacggggcccgtatttctttaatcgtacccgtaagtacgtaacctaaactttaccgaagggtaacctaattaaccgtgtaacgtttacgtagtctaaggttcggaaccaagtaactaggaacgtaggttaccgaagggtaccaaccggggtaccgttaagttaacgtttagttacggttagttaaacggtcgggtacgttagggtacgggtaccttaacgggtacgttccggttacggggggacccgggtaaacccgtcgggttaccgtacccgggtttcttaccgttccgtaaccgg

SEQ ID NO: 280595 - DNA, 558 bp, Homo sapiens
  misc_feature: GYAE6OF01DRCIF.47.2.A02.1.454.CMB.1.raw
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagagctcacgtacacgaccggtgctcgatttagactcatctacgaggggaaagggggaggaactgctcagttaggacccagacggaaccatggaagccccagcgcagcttctcttcctcctgctactctggctcccagagaccactggagaaatgtgatgacgcagtctccagccaccctgtctgtctcgtccgaggggaaangccaccatctcctgagggccgtnagagtattagcatcaattagcctggtaccagcagagactgggcaggctcccaggctcctcatctatgatgcgtccactaggccactcggttcccagcctaggttcagtggcagngtcgtcgtgggacagngttcactntcaccatcaacagcctgacagtctagagtatttgctagtttattactgtcagcagtatacagtaactcggaccgtctactacccgtcggtaccgaaacgggtaccgaaccggtaccgtacgggaaaggtaacgttaaaaccggtaacgttacggttacggccgttacgaccgtaaccctattccgttacccg

SEQ ID NO: 280596 - DNA, 462 bp, Homo sapiens
  misc_feature: GYAE6OF01DIBWF.47.2.A02.1.454.CMB.1.raw
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
  modified_base (434)..(462): a, c, t, g, unknown or other
  misc_feature (434)..(462): n is a, c, g, or t
tcagagctcacgtacacgaccggtgctcgatttagactcatctacaggggaaagagccaccatctcctgtagggccggtcagagtattagcatcaacttagcctggtaccagcagagacctgggcaggctcccaggctcctcatctatggtgcatccaccagggccatggtatcccagccaggttcagtggcagtgggtctgggacagacttcactctcaccatcagcagcctagacgcctagaagtactttggacttttattactgtcagcagcgtgtagttctcggcctccgctctacgtttcggcggagggaccgagggtggagaactacgaaacgtactgtggctgcaccatctcgtctcgtctcttcccgcatctcgatcgtgacgcttcnggaggcgggctggggacaacgggcgacgagtacgancnnnnnnnnnnnnnnnnnnnnnnnnnnnnn

SEQ ID NO: 280597 - DNA, 556 bp, Homo sapiens
  misc_feature: GYAE6OF01B4CAU.47.2.A02.1.454.CMB.1.raw
  modified_base (468)..(468): a, c, t, g, unknown or other
  misc_feature (468)..(468): n is a, c, g, or t
  modified_base (514)..(514): a, c, t, g, unknown or other
  misc_feature (514)..(514): n is a, c, g, or t
  modified_base (520)..(522): a, c, t, g, unknown or other
  misc_feature (520)..(522): n is a, c, g, or t
  modified_base (526)..(526): a, c, t, g, unknown or other
  misc_feature (526)..(526): n is a, c, g, or t
  modified_base (529)..(530): a, c, t, g, unknown or other
  misc_feature (529)..(530): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(539): a, c, t, g, unknown or other
  misc_feature (537)..(539): n is a, c, g, or t
  modified_base (541)..(556): a, c, t, g, unknown or other
  misc_feature (541)..(556): n is a, c, g, or t
tcagagctcacgtacacgaccggtgctcgatttagactcatctacaggggaaagagccaccatctcctgtagggccggtcagagtattagcagcaacttagcctggtaccagacaagaaacctgggcaggctcccgaggctcctcatctatgatgctccacaggccactggttccagccaggtcagtgcagtgcgtctgggacagtacgttcactctcacatcaacacgcctagctagtctagtacgtatttgactagttttaactactgtaccagtactacgtataccgaattaaccgcgggtaccctcttaccacccggtttaccgggaccgaaaggggacaacggtacgtaagggtaacgtaaacgttaaaacggacgtggtaggtcgacgtaccacctattcgtacgttcttactaccgtcccttaccgcgtacttcgtagtaaccgacggtacgattcccgtntaacggcggtcgcgtagggaccctaaggggcaccgtaatgggactntaccgnnntagntannannanannnannnnnnnnnnnnnnnn

SEQ ID NO: 280598 - DNA, 575 bp, Homo sapiens
  misc_feature: GYAE6OF01CIOVC.47.2.A02.1.454.CMB.1.raw
  modified_base (204)..(204): a, c, t, g, unknown or other
  misc_feature (204)..(204): n is a, c, g, or t
  modified_base (535)..(535): a, c, t, g, unknown or other
  misc_feature (535)..(535): n is a, c, g, or t
  modified_base (540)..(544): a, c, t, g, unknown or other
  misc_feature (540)..(544): n is a, c, g, or t
  modified_base (546)..(547): a, c, t, g, unknown or other
  misc_feature (546)..(547): n is a, c, g, or t
  modified_base (549)..(551): a, c, t, g, unknown or other
  misc_feature (549)..(551): n is a, c, g, or t
  modified_base (553)..(556): a, c, t, g, unknown or other
  misc_feature (553)..(556): n is a, c, g, or t
  modified_base (558)..(558): a, c, t, g, unknown or other
  misc_feature (558)..(558): n is a, c, g, or t
  modified_base (561)..(568): a, c, t, g, unknown or other
  misc_feature (561)..(568): n is a, c, g, or t
  modified_base (570)..(571): a, c, t, g, unknown or other
  misc_feature (570)..(571): n is a, c, g, or t
  modified_base (573)..(575): a, c, t, g, unknown or other
  misc_feature (573)..(575): n is a, c, g, or t
tcagagctcacgtacacgaccggtgctcgatttagactcatctacaggggaaagagccaccatctcctgtagggccggtcagagtattagcatcaacttagcctggtaccagcagagacctgggcaggctcccaggctcctcatctatgatgcgtccaccagggccactcggtttcccagccaggttcagtggcagtgcgtcgngggacagagttcactctctacatcaactagcctagacgcctagaagtacgtttggtacttttattacctgtcagcagcgtggtacgttcgtcggcccttacccggtcctccgtaccggttttccgggaccgggtagggacccgaggggtggaacgtataccggaaaacggaccttggtggccttacgacctacctagttcccgttcggttaccttccacttcccgtttccccggaccttacttccgtagtaccgttcgtacgacgtccgtttcggtacggacgggtccggggtagttaccggggaccctaacggggcctacgaaagcggtnagcannnnncnngnnngnnnngngcnnnnnnnncnncnnn

SEQ ID NO: 280599 - DNA, 740 bp, Homo sapiens
  misc_feature: GYAE6OF01A5X3U.47.2.A02.1.454.CMB.1.raw
  modified_base (191)..(191): a, c, t, g, unknown or other
  misc_feature (191)..(191): n is a, c, g, or t
  modified_base (531)..(531): a, c, t, g, unknown or other
  misc_feature (531)..(531): n is a, c, g, or t
tcagagctcacgtacacgaccggtgctcgatttagactcatctacgaggggtaaagggggtctgagagaggacgcccagcccgtcgggattttcaggtgttttcatttggtgatcagggactgaaccgagagaacttcaccatggagtttgggctgagcgtggctcttcgtcgtggtactttttaaaaggngtccagtgtggacggtgctaagtggttggtacgtcggtggggagtacgttacgtaccgtacccgtgggggtccctgacgtactcgtcctgtcgctacgtcctcgtacgtacctactaccgttagacctaacctcgtgtacctaggtcggcgtcggtaccgccgacgggtccggacggggaacggtccgtaggtcggtggtactacgagttcgtgaacggtagtagtacgtaggtaggaacgtcagtacgtcgtacggtcggtacctcgggtacggtaccgggtccgttacaccgtactccgaccgaagtaccgaacttacgtccgaggacctacgacgtnttacgatacgtaacgtaatacggtaactgtagtacgagaccggtacgaacgggtaccgtacggttcgttaacgttcggttaccggaggttaacggtacgtaaacggttcgtaacggtaccgtacccgtaacggttcccccgaaaccccgttagtcccgttaaaccgtcccgttttaaggtcccgggtacgttcccggggtaacccgggg

SEQ ID NO: 280600 - DNA, 754 bp, Homo sapiens
  misc_feature: GYAE6OF02F5DL4.47.2.A02.1.454.CMB.1.raw
  modified_base (223)..(223): a, c, t, g, unknown or other
  misc_feature (223)..(223): n is a, c, g, or t
  modified_base (312)..(312): a, c, t, g, unknown or other
  misc_feature (312)..(312): n is a, c, g, or t
tcagagctcacgtacacgaccggtgctcgatttagactcatctacagggtaaagggggtctgagacgaggagcccagccctgggattttcaggtgttttcagtttggtgatcaggactgaaccgagagaactcaccatggagtttgggctgagccgtggcgtcttacgtgtggctttttaaaaggtgtccacgtgtgaggtgcaactgttggagtctgggganacttaggtacaccctggggggtccctgacgactctcctgtgcgagcctctggactcaccttagcaaactctagtcatggactgggtccnccaggctccggggaaggctggacgtgggcctcgaggctagttcgggtggtaagtggttggaccgtagggaccacgtagttaaccggtaaaagtcccctaggtacacggggacccgtagtttaccttttaagccgttaccgaaggtaacgtaaccttaaacgtttacccgaaacgggtaaacctaagtttaccgtagggtaaacttttacccgttagggtaccttaaggtttacgaacccgtaaggtaacccttaggtacggtaacgttaccgggaaggttaccgtaacggggtcccgttaagttaacgtttacgttacggttaagtttaaaacccgtggggttaacttcgggtacggtaaccgttaacgggtaaccgttccggtttacgggggaccccgggtaacctgggttacccgaccggttccttaccgttccaaccgg

SEQ ID NO: 280601 - DNA, 648 bp, Homo sapiens
  misc_feature: GYAE6OF02HY403.47.2.A02.1.454.CMB.1.raw
  modified_base (406)..(406): a, c, t, g, unknown or other
  misc_feature (406)..(406): n is a, c, g, or t
tcagagctcacgtacacgaccggtgctcgatttagactcatctactaggggtaaagggggtctgagacgagggagccccagccctgggtattttcaggtgttttcatttggtgatcaggactgaaccgagagaactcaccatggagtttgggctggagcgtggctcgttttcttgtggtcttttttaaaaggtgtccagtgtgaggtgcaactgttggagtcgtgggggatacttagtacacccgtgggggtccctggacgtactctccgtgtcgcagtccttcgtggacctcctaccgttttagcctaaacgtcttgtcagtgggcttcggggtccgcccgaggccgtaccgggggaagggggcctgggaggttgggtctcaagtattgattgagatgggtgaancactattctagtgactccggtgaacgggtccgttacaccctagtcctacagtacgactaagttcgaaggagctacgacttagtatacgttaactaaagtacgaactagtactagagacggacgacggaccgacgggtaccgttaagttacgttacgttgtacgtacgtaagttacgtagtgtacgtacggtccgtcccccgtaggtccgtaccgtccgtttacggtcgtacgttccgtcggg

SEQ ID NO: 280602 - DNA, 848 bp, Homo sapiens
  misc_feature: GYAE6OF02HVX8U.47.2.A02.1.454.CMB.1.raw
  modified_base (206)..(206): a, c, t, g, unknown or other
  misc_feature (206)..(206): n is a, c, g, or t
tcagagctcacgtacacgaccggtgctcgatttagactcatctactgggaaagggggaggaactgctcagttaggacccagacggaaccatggaagccccagcgcagcttctcttcctcctgctactctggcctcccagagaccagtcggagtaagttgtgttgacacagtctccagccaccctgtctttgtctccgaaggggaanacgcccacctctcctgcgagggccagtcagatatcactctacttacgcctaggtaccaacgacgaaacctgggtaccacggtcctacccgaggtccctcctacatctatgatcgcaactaccaacggaccggccaacgtcggaccacgtccccaaggacgtagggttcaagggtcggcgtaaggggttcgggtacggtacggggtaacctaacggttaccctttccgacccgttaccttaccccaaccttacgtacccgacgggtaccgaacccggtacccgtaaagggtaccctacccggttaaggtaaaacggtttaccgtttttacgggtaaaccttttttaattaccgttcggtttaaccgacgttacgttaccgggttcggttacggtttacccgggttccgggttaccggtcccccgtttacccggttccgtttacccgggttttcccgggtttaacccggggggacgggggttaacccgggggttaacccgggttaggggggttaccggggaaaccgttaaccgggtaaaacccggttaaaccggggtaacggttccgggtaacggggttacccttacgggaacccccgttaacctacgggttttcccgtttaccggtttaccccttaccccggg

SEQ ID NO: 280603 - DNA, 694 bp, Homo sapiens
  misc_feature: GYAE6OF02G2IE2.47.2.A02.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
tcagagctcacgtacacgaccggtgctcgatttagactcatctacgtagggtaagggggaggaactgctcagttaggacccagacggaaccatggaagccccagcgcagcttctcttcctcctgcctactctggctcccagacgaccactggagaaatagtgatgacgcagtctccagcccacctgtctgtctcgtccaggggaaangccaaccacttccgtcgngtacgggcccgtacgacgagtagttacgtcgactacgtaactacgtccgtcggtaaccgacgcgaacgacgtacccgtgggaccgacggtccctacccgaggccttccgtactaacgtccttagtcgacgttcgcctaccgaaccgcggggtaccctcggttcggtccacggtcccaagtcgtacggttgccgtaggtgtaccggttggtcggtagacgcgttacacgtcctccaacgctacaccgacgtcgacgacgtacgtacaggttaacgttgttacgtcgtttacgtttacttacgtttacgttacgtacgtacgtattacgacttacgtaccgttaacgtccgtacgtacccgttaccggtacgggtaccgaaccgggtacgtaaccggtaaggtacggtaaacggtaccgtaaacggtcggttacggtacggacgtcgtaacctacggttactaccgttacg

SEQ ID NO: 280604 - DNA, 843 bp, Homo sapiens
  misc_feature: GYAE6OF02FW70D.47.2.A02.1.454.CMB.1.raw
  modified_base (205)..(205): a, c, t, g, unknown or other
  misc_feature (205)..(205): n is a, c, g, or t
  modified_base (353)..(353): a, c, t, g, unknown or other
  misc_feature (353)..(353): n is a, c, g, or t
tcagagctcacgtacacgaccggtgctcgatttagactcatctacgagggaaagggggaggaactgctcagttaggacccagacggaaccatgaagccccagcgcagcttctcttcctcctgctactcgtggcctcccagagaccacgtggacgaaatagtgatgacgcagtctccagccacctgtctgtctctccgaggggaanagccaccgatctccgtaggtacgggccgtcgacgtagtaattgacagttacaactttaggccttagggtaccaggctaaggacgtaccgtggggcctagggtcctccccgaagggtcctacccgtacgaattcctaacgtcggtaacncggtcccgttaccccgaaaccggtggggtaccccttaacgttcggggttttacccccaacggtacccttaagggggtttaccagggtttccgggacctaaggtcggtccggtttacgtaggggggaacccaaggttccgggtttacctaccttcgttaccccgaaacctaacgtttacccaaaacccgttacgggtaacccttcggacccttaacggttccgtttaaaccggtaaaaggttttcgtttttaccgggtaaccgttaaacggtttttaaaccttttaacgttccggtttaaaccgttaacggtacttaacggttaacgtttacctaacgttaaaccgttcgggtacccgtaccttcgtaaaccccgtttcgggaacccgtaacggggtacccgtaacggtaccggtaacggtaaccggttaaacgtaaaccggtacgttacggtaaccggtcgttacgaccgtaccctagtttacctaccgg

SEQ ID NO: 280605 - DNA, 687 bp, Homo sapiens
  misc_feature: GYAE6OF02HIZ2P.47.2.A02.1.454.CMB.1.raw
  modified_base (169)..(169): a, c, t, g, unknown or other
  misc_feature (169)..(169): n is a, c, g, or t
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (684)..(684): a, c, t, g, unknown or other
  misc_feature (684)..(684): n is a, c, g, or t
tcagagctcacgtacacgaccggtgctcgatttagactcatctactagggtaagggggaggaactgctcagttaggacccagacggaaccatggaagccccagcgcagcttctcttcctcctgctactctggcctcccagacgtaccactggagaaatagtgatgacgnagtctccagtcccacccgtgtctgtcctctccgaaggggaaangccacatcctctggtacggccggntagactattgctatcgaacgttgccgtcggtacacgtacagacgaccgtggcgacgcctccgacgtccgtacctntacgtctatcgtctcgcctccaccgaggccctcgttacgttccacgtcctaggtccaaggtcgagcgtcggtacggttcggacgggtaaccgtaggtaccgttccgtaaccgttcctacccgaaccgtataccgtaaaccgcgttacccgtaggtacgttacggtcgttaagtacggtttaagtttcgtaacgttaatttacgtttacgttacgttaatcgtaccgtagtttaactacgtaacgtacgtaccgtcccgttccgaacccggttcccgtacgggtaaccgtaccgggtacggtacgtaacggttggaaacgttacgtaaaccggtagtaacgttcggtaacggtgtaacccgtacgtcgtttacnccg

SEQ ID NO: 280606 - DNA, 819 bp, Homo sapiens
  misc_feature: GYAE6OF02ID32Z.47.2.A02.1.454.CMB.1.raw
  modified_base (809)..(809): a, c, t, g, unknown or other
  misc_feature (809)..(809): n is a, c, g, or t
tcagagctcacgtacacgaccggtgctcgatttagactcatctacaagggaaagggggaggaacggtgctcagttaggacccagacggaaccagtggaagccccagcgcgagcttctcttcctcctgacctactcgtggcctcccagagaccactggagaaataggtgagttcgacgctagttctaccgagccctaccctgtctgtcctcgtccgaaggggaaacacgccaaccgtgtcctcggtagggtacggggccgttacgaggtacggttagttacgctaacgttacctaacgtttcgtccgttcggtaccgacgcgaacggtacgccggttaggctaacggtcctacccgacgggtcctaccctcgtacgttccgttacgcggtacgtccgcccgtacccgaccgggtacggccgttacggtttccggttacccgacgtcgtaacggttcaaggtcgtgtacggtcgtcggtacgtaacggtaactcggttacttacctaccggtcctaccaaccgtacgaaccgtacgtcgttcccgaagtcccgtagttccgtaaggttaactttaacgtttcggaaccttttaaaggttttacgtaccgttacgtacgtacgtacgtttaacgttaaccttaacggttaacctaccggttccggtaccccgttagttacccccgtaacggttaaccgggtaccggtaaaaccgggcccgtttaaggtaaccgggtaacgttaaacggttaaaacgtaaaccggtttctaccgggttaggacccgttaagaccccggtaatttaccgggttntttaacccgg

SEQ ID NO: 280607 - DNA, 262 bp, Homo sapiens
  misc_feature: GYAE6OF02I5PPG.16.14.B03.1.454.CMB.1.raw
  modified_base (259)..(262): a, c, t, g, unknown or other
  misc_feature (259)..(262): n is a, c, g, or t
tcagtgtactactccacgaccggtgctcgatttagtgtgagtagtttgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtcttcatcttcccgccatctgagagtagtacactgagcgggctggcaaggcgcatagnnnn

SEQ ID NO: 280608 - DNA, 259 bp, Homo sapiens
  misc_feature: GYAE6OF02HBJ3X.16.14.B03.1.454.CMB.1.raw
  modified_base (258)..(259): a, c, t, g, unknown or other
  misc_feature (258)..(259): n is a, c, g, or t
tcagtgtactactccacgaccggtgctcgatttagtgtgagtagtttgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtcttcatcttcccgcatctgagagtagtacactgagcgggctggcaaggcgcatagnn

SEQ ID NO: 280609 - DNA, 225 bp, Homo sapiens
  misc_feature: GYAE6OF01AO2L5.21.89.I01.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtatgctagtatggggccaagggaccactgtcaccgtctcctcagcctccaccaagggcccatcggtcttcccctggcaccctcctccaagagcacctctggggcacagcggccctgggctgcctggtcaaggactacttcccgccatctgatatacgatcgctgagcgggctggcaaggcgcatagnnnn

SEQ ID NO: 280610 - DNA, 224 bp, Homo sapiens
  misc_feature: GYAE6OF01E27NF.21.89.I01.1.454.CMB.1.raw
  modified_base (223)..(224): a, c, t, g, unknown or other
  misc_feature (223)..(224): n is a, c, g, or t
tcagtcgtcgctcgcacgaccggtgctcgatttagtatgctagtatggggccaagggaccactgtcaccgtctcctcagcctccaccaagggcccatcggtcttcccctggcaccctcctccaagagcacctctgggggcacagcggccctgggctgcctggtcaaggactacttcccgccatctgatatacgatcgctgagcgggctggcaaggcgcatagnn

SEQ ID NO: 280611 - DNA, 279 bp, Homo sapiens
  misc_feature: GYAE6OF02GDR07.21.89.I01.1.454.CMB.1.raw
  modified_base (233)..(234): a, c, t, g, unknown or other
  misc_feature (233)..(234): n is a, c, g, or t
  modified_base (236)..(279): a, c, t, g, unknown or other
  misc_feature (236)..(279): n is a, c, g, or t
tcagtcgtcgctcgcacgaccggtgctcgatttagtatgctagtatgggggccaaggggacctactgtcaccgtctcctcagcctccacctaacgggcccatcggtcttccccctggcaccctcctccaagacgcacctctggggcacagcggccctgggctgccgtggtcaaggactacttcccgccatctggatatacgatcgctgagtcgggctgggcaaggcgcatagnncnnnnnnnnnnnnnnnnnnnnnnnnnnnnnnnnnnnnnnnnnnnn

SEQ ID NO: 280612 - DNA, 277 bp, Homo sapiens
  misc_feature: GYAE6OF02F2VW7.21.89.I01.1.454.CMB.1.raw
  modified_base (231)..(234): a, c, t, g, unknown or other
  misc_feature (231)..(234): n is a, c, g, or t
  modified_base (236)..(277): a, c, t, g, unknown or other
  misc_feature (236)..(277): n is a, c, g, or t
tcagtcgtcgctcgcacgaccggtgctcgatttagtatgctagtatggggggccaagggaccactgtcaccgtctcctcagcctccaccaagggcccatcggtcttcccctggcaccctcctccaagagcaccctctggggcacacgcggccctgggctgcctggtcaagggactacgttcccgccatctgatatacgatcgctgagcgggctggcgaacggcgcagtagnnnntnnnnnnnnnnnnnnnnnnnnnnnnnnnnnnnnnnnnnnnnnn

SEQ ID NO: 280613 - DNA, 539 bp, Homo sapiens
  misc_feature: GYAE6OF01CVF7O.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtatccagacttcctatttgtatctctgggcgagagggccaccatcaactgcaaggcaagccagattattttatacagctccgacagtaagaactacttatcttggttccaacagaaaccaggacagcctctaaattctcatttattccacatctatgcggcctccggggtcccaccgattcagtggcagcgggtctggacagattcactctcacaatcagcagcctgcagactgaagatggtggtcgtttattattgtcaactaatattctctttgtttaccgtttaatttcggcggagggaaccgtaagggtgagatacaacggtaactggtcggcgttagccgaccagttcttcggtcttacctatccctttaccccgcctactcgttgtacg

SEQ ID NO: 280614 - DNA, 555 bp, Homo sapiens
  misc_feature: GYAE6OF01CIIBO.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaattactcatttatccacatctatgcggcctccggggtccccgaccgattcagtggcagcggtctgggacagatttcactctcacaatcagcagcctgcagactgaagatggtggtctttattattgtacaaactaattatttctactttgtttaccgttttaagtttcgggcggtaagggaccctaaggggtgagatacgaaacgtaacgttggtacggcttaggcctacctattctcgttaccttcacttccttaccccgcctattccgtgtacg

SEQ ID NO: 280615 - DNA, 596 bp, Homo sapiens
  misc_feature: GYAE6OF01AXB3O.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaattactcatttatccacatctatgcgggcctccggggtccccacgattcagtggcagcgggtctgggacagattcactctcacaatcagcagcctgcagactgaagatggtgggtcgtttattattgtacaaactaattatttcttctttgtttacccgttttaaagtttcgggacggtaaggggtaccctaaagggtggaagtattacgaaaacggtaacttggtagggtactaggacctaacccgtattccgttcggttacccttttaccgaacgtttcccctttacccccggacctaacgttccgtggtaaacg

SEQ ID NO: 280616 - DNA, 610 bp, Homo sapiens
  misc_feature: GYAE6OF01BBG9K.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagtacttcctatttgtatctctgggcgagagggccaccatcaactgcaaggcaagccagtattattttatacagctccgacagtaagaactacttatcttggtaccaacagaaaccaggacagcctacctaaattactctatttatccacatctatggccgggccgtcccggggtccccgaccgattcaggtggcaggcgggtctgggacagtatttcactctcaacaatcagcagcctgcagactagaagatggtggtacgttttattattgtacaaactaattatttcttacgttttcgtttaccgttttaagtttcgggacgggtaacgggtaaccgtaagggtggaagtactaccgaaaacgtaacgttggtacggtactacggaccgtaacctagttcgttcgttaccttacctacgtttccccttacccccgacctaacgttccgttaggtaacg

SEQ ID NO: 280617 - DNA, 568 bp, Homo sapiens
  misc_feature: GYAE6OF01CH5P8.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaattactctatttatccacatctatgcggcctccggggtccccaccgattcagtggcagcggtctggacagtatttcactctcacaatcagcagcctgcagactagaagagtggtgggtcttttaattattgtactaaactaattattcttactttgtttaccgttttaagtttcgggacggtaacgggtacctaaagggttggaagtactacgaaacgtaacttggtaggcttgacctaccgtattccgtgttacttcaacttcccttccccgacctacttcgtgtacg

SEQ ID NO: 280618 - DNA, 532 bp, Homo sapiens
  misc_feature: GYAE6OF01D7R6V.11.31.C09.1.454.CMB.1.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (508)..(508): a, c, t, g, unknown or other
  misc_feature (508)..(508): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaattactcatttacttccacatctatgcgggcctccgggtcccacgattcagtggcagcgggtctggacagatttcactctacacaatcagcagcctgcagactgaagntggtggtctttatnttgacaactatatttctctttgtttccgtttaattcgggacggtaagggtaccaaggggtgagtatacaaacggtactggtcgctgacctacctattcgttgtcttnacttccctcccgctatcgtgtacg

SEQ ID NO: 280619 - DNA, 649 bp, Homo sapiens
  misc_feature: GYAE6OF01CAWKT.11.31.C09.1.454.CMB.1.raw
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatcgacccagtctccagacttcctatttgtatctctgggcgagagggccaccatcaactgcaaggcaagccagtattatttanacagctccgacagtaagactacttatcttggtaccaanagaaccaggacagcctacctaaattactctatttactaccactatctatcgaccgggcccgtcccggggtaccccacgtattcgagtggcaggcggtctggacagtattcactcacacaatcagcagcctgcagactgaagtatcggtaggaccttaagtttaacgttacgtgttacgaagtactaaggttacgttaggtacgaaacggtccgtacccggtaccttacccgtaaccgggttttaccggggccggggaacgggtaccccgggtcggggttacgggaacgtaaccggttaccgaacgggtaacccggtaaacgttgggtacgggtacctacggacctaacccgtgttaccttccgggtttacctttaccgaaccgtttcccccgg

SEQ ID NO: 280620 - DNA, 665 bp, Homo sapiens
  misc_feature: GYAE6OF01DEFAK.11.31.C09.1.454.CMB.1.raw
tcagcgagagataccacgaccggtgctcgatttagacgtctcatcaaggaaggaaggggcagcaagatggtgttgcagacccaggtcttcattctctgttgctctggatctctggtgccaacggggacatcgtgatgacccagtctccagacttcctatttgtatctctgggcgagagggccaccatcaactgcaaggcaagccaagattattttatacagctccgacagtaagaactacttatcttggttaccaacaagaaaccaggacagacctacctaaattactctatttattccacatctatgcggcctccgggcccacgattcgagtcgcgaggcgtcgtggacagtattcactctacaacaatcgagcacgtcctgaccagtaactaggaaagagttgggtacgggttacgttttaattacgttgtaacctaaactaacttagtttaccttacgtttacgttttaccgttttaaaggtttcggggtaacggaacggggtaaccgtaaaggggttcggaaagtacgttaaaccgaaaccggtaacgttcggtaacgggaccttacggaacccttaccgtaaagtttccgttacgtttccctttacgttaacccgtttcccgtttacccccgacccttaagtttcccgtggttaaaccgg

SEQ ID NO: 280621 - DNA, 541 bp, Homo sapiens
  misc_feature: GYAE6OF01BXXRB.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttgttccaacagaaaccaggacagcctactaaattactctatttactccacatctatcgccggcctcccggggtccccaccgattcagtcggcaggtgggtctggacagtatttcactctcaacaatcagcagcctgcagactgaagagtggtgggtctttattattgtacaaactattattcttctttgtttaccgtttaagttcgggacggtaagggtaccgtaagggtgagtataacgaaacgtactggtagctgaccactatctgtcttcacttcctcccgatctcgtgtac

SEQ ID NO: 280622 - DNA, 600 bp, Homo sapiens
  misc_feature: GYAE6OF01EDHAE.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaattactcatttattccacatctatgcggcctccggggtccccgacgattcagtggcagcgggtctgggacagatttcactctcacaatcagcagcctgcagactgaagatgtgggtctttattattgtacaactaattattcttctttgtttaccgttttaaagtttccgggacggtaagggtacccgtaaggggttggaagtaattaaccgaaaacggtaacgttggtacgggaccttaggaccctaacccgtatttccgttgttaccctttcgaacctttcccgtttaccccccggccttaagttcccgtggtaaaccg

SEQ ID NO: 280623 - DNA, 585 bp, Homo sapiens
  misc_feature: GYAE6OF01DNA98.11.31.C09.1.454.CMB.1.raw
  modified_base (389)..(389): a, c, t, g, unknown or other
  misc_feature (389)..(389): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctcgacagtaagaactacttatcttggttaccaacagaaaccaggacagcctacctaaatactacatttactccacatctatgccgggcctccggggtccccaccgattcagtgcaggcggtctgggacagtatttcactctcacaatcagcagcctgcagactgaagngtggtggtcttttaattagttgtaccaaataacttattcttacttttcgtttaccgttttaaagtttccgggacggtaacgggtaaccgtaaggggttcggaagtacttaccgaaaacggtacgttgtacggctgaccctaactattcgttcgttaccttcacttcccgttacccccgactactcgtggttaaacg

SEQ ID NO: 280624 - DNA, 531 bp, Homo sapiens
  misc_feature: GYAE6OF01CZM78.11.31.C09.1.454.CMB.1.raw
  modified_base (217)..(217): a, c, t, g, unknown or other
  misc_feature (217)..(217): n is a, c, g, or t
  modified_base (521)..(521): a, c, t, g, unknown or other
  misc_feature (521)..(521): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttanacagctccgacagtaagaactacttatcttggttccaacagaaaccaggacagcctacctaaaattactcatttattccacatctatgcgggcctccggggtcccgaccgtattcagtcggcaggcgggtctgggacagtacttcactctcacaatcagcagcctgcagactgaagagtgtgggtctttaattattgtacaactaattattctctttgttccgtttaatttcgggacgtagggacctaagggtgagtatcaaacgactgtgcctgacctacatctgtcttcgattcctacccgntatcgtgtac

SEQ ID NO: 280625 - DNA, 591 bp, Homo sapiens
  misc_feature: GYAE6OF01CFWZ7.11.31.C09.1.454.CMB.1.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
  modified_base (429)..(429): a, c, t, g, unknown or other
  misc_feature (429)..(429): n is a, c, g, or t
  modified_base (549)..(549): a, c, t, g, unknown or other
  misc_feature (549)..(549): n is a, c, g, or t
  modified_base (583)..(583): a, c, t, g, unknown or other
  misc_feature (583)..(583): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatcgacccagtctccagacttcctatttgtatctctgggcgagagggccaccatcaactgcaaggcaagccagattatttanacagctccganagtaagactactatcttgtaccaacaagaaaccagacagcctactaaatactctatttatccanatctancggccggcctcccggggtccccacgattcgagtggcaggcggtctggacagtattcactnacaacatcagcacgcngacagactagaagngttggtagggttcgttttaattattagtaccaaattaattntttacttccgttttagttacccggtttttaaattcggggaccggtaagggtaaccaagggggttagagtaactacaaaccgaagttggtggaccttgacccgtacctagttccgtttacnccgttactcttaccccttcccgacctattaccgngtaaaccg

SEQ ID NO: 280626 - DNA, 583 bp, Homo sapiens
  misc_feature: GYAE6OF01AJG03.11.31.C09.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttanacagctccgacagtaagaactacttatcttggttccaacagaaaccnggacagcctacctaaattactcatttatccacatctatgcgggcctccggggtccccacgattcagtgcagcgggtctgggacagtattcactctcacaatcagcacgcctgcagactagaagatggtgggtacgttttattacttgtacaaactattacttctctttacgtttaccgtttaacgtttcgggacgggtaacgggtaccgtaagggtaggacgtaacgtaccgaaaacgtacgtggtacggcgttacgaccgtacctagttcctcgttccttactaacgttcccgttaccccgacctgttccgtgtaacg

SEQ ID NO: 280627 - DNA, 637 bp, Homo sapiens
  misc_feature: GYAE6OF01A2BGO.11.31.C09.1.454.CMB.1.raw
  modified_base (219)..(219): a, c, t, g, unknown or other
  misc_feature (219)..(219): n is a, c, g, or t
  modified_base (624)..(624): a, c, t, g, unknown or other
  misc_feature (624)..(624): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtatttattttanacagctccgacagtaaagaactacttatcttggttaccaacagaaaccaggacacgcctactaaattactctatttacttccatactcttatcggccgggtcccgtcccggggtccccgaccgtattcaggtcggcacggtcgggtcgtagggacagtacttcactctacactaactcacgcacgcctgaccaggactaggaagtagttgggtaggttacgttttaattattacgtactaaacgttaattcttttccttacgttttacggttttaccgttttaaacgtttcggggaacgggtaaccgggtaaccgtaagggttggaacgtactaacgtaaacgacgttggacgtcgtacgacgtaacctgttacgttcgtaccttcgtacttcccgttaccccgntactgtacggtac

SEQ ID NO: 280628 - DNA, 642 bp, Homo sapiens
  misc_feature: GYAE6OF01BLZKJ.11.31.C09.1.454.CMB.1.raw
  modified_base (219)..(219): a, c, t, g, unknown or other
  misc_feature (219)..(219): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagtacttcctatttgtatctcgtgggcgagagggccaccatcaactgcaaggcaagccagtattatttanacagctccgacagtaagaactacttatcttggttaccaacaagaaaccaggacacgtacctactaaattactctatttactccactatctagtcggccgggtccgtcccggggtccccgacgtattcgagtcggcaggcggtcgtggacagtacttcactctacactaactcagcacgcctgacagactagaagtgttggtaggttactttattagttcgactaaacgttaattctttccttacgttttacggttttacccgttttaagtttcggggaccggggttaacgggtaacccgtaaggggtaggtaacgtaacgttaacggaaaacgtacgttgggtacggtcctacggacctaccgtattccgttcgttaccttacctactttccccgtaccccgtactacttccgtagttaaccg

SEQ ID NO: 280629 - DNA, 603 bp, Homo sapiens
  misc_feature: GYAE6OF01EA300.11.31.C09.1.454.CMB.1.raw
  modified_base (415)..(415): a, c, t, g, unknown or other
  misc_feature (415)..(415): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattattttatacagctccgacagtaagaactacttatcttggttaccaacaagaaaccaggacacgcctacctaaattactctatttacttccacatctagtcggccgggcccgtcccggggtccccgacgtacttcgaggtcggcgaggcgggtcgtggacagtacttcactctcactaatcagcacgcctgacagactagaagtntgggtggtactttatagttcgaacaataattctttcttcgtttgtttaccgtttaagttcgggacggtaacgggtacctaagggtggaatactaacgaaacgtactggtcggctacggaccctaacctattcgttcgtttcctttaactccccgtttccccgacttacgtttcgtaggtacgtttacc

SEQ ID NO: 280630 - DNA, 618 bp, Homo sapiens
  misc_feature: GYAE6OF01E0TOW.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttaccaacagaaaccaggacagcctactaaattactctatttatcccacatctatcggccgggtcccgtcccgggggtcccccgaccgtactttccgagtcggcgaggcgggtctgggacagtacttcactctcacaatcagcacgcctgcagactagaagtatggtgggtacttttattagttagtaccaaacttaattacttcttctttgtttacccgtttaagtttccgggcgggtaacgggtaccgtaaggggtcgggaagtaacgtacgaaaacggtaaccgttggtacggtcctacgaccgaccttaagtccttcgttaccttcctaacttcccgtttaccccgacccttattccctggtaacg

SEQ ID NO: 280631 - DNA, 661 bp, Homo sapiens
  misc_feature: GYAE6OF01BK42B.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacacgcctacctaaattactctatttatccactatctatcggccgggcccgtcccggggtccccgaccgattccgagtggcaggcgggtctggacagtattcactctcacatcagcagcctgactagactagaacgtatggtaggggtcttttaattagtttgtacaaacttaattactttccttacgttttcgttttaccgttttaagtttcgggacgggtaacgggtacccgtaaaggggtcggaacggtacttaaccgaaacggtaacgttgggtacggtaccttggacccgtaacccgttattaccccggtttagtttcccccgtttacttaaccccgtttcccccgtttaccccccggtacccttaaacgtttccccgttagggttaaacg

SEQ ID NO: 280632 - DNA, 785 bp, Homo sapiens
  misc_feature: GYAE6OF01CHW97.11.31.C09.1.454.CMB.1.raw
  modified_base (230)..(230): a, c, t, g, unknown or other
  misc_feature (230)..(230): n is a, c, g, or t
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatcgacccagtcctccagtaccttcctatttgtatctgtgggcgaggcgggaccaccatacaactgacgaaggacaagccaagtatttatttanacagcctaccgaactaagtaactaacttacttatcgttacggtaccaaacaacgaaaccgaggaaccacgtaccctaactaaattactactaacttactaccaactatctagtccggaccggtcccgtacccggggtcccaacgtagttacgaggtcgaccgtacggcgggtcgtacgggaactagttaccttccgactacctaacgaaactactaccgaacgctaccggtacctaggacctaaggtaacgaaggtacgtaggtttaggggttacgggttttaaccttttaattaacgtttacggtaaacctaaacgtttaaactttcgtttacgttttacgtttacggtttttaacgtttaaccggggtccggggtaacgggaaccgggttaaccggtaacgggggtaaggtaaaccgttaacgtaaaccggaaacggtcggttacgggttacgaccgttaccgaacccgttaacctacgttacgtttccgtacctttaccccgtacctttccccccgttaccgtaaccgttcttaacgggttaacgttacccg

SEQ ID NO: 280633 - DNA, 585 bp, Homo sapiens
  misc_feature: GYAE6OF01B61KO.11.31.C09.1.454.CMB.1.raw
  modified_base (218)..(218): a, c, t, g, unknown or other
  misc_feature (218)..(218): n is a, c, g, or t
  modified_base (325)..(325): a, c, t, g, unknown or other
  misc_feature (325)..(325): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctactgggcgagagggccaccatcaactgcaaggcaagccagattattttanacagctccgacagtaagactacttatcttggttaccaacagaaaccaggacacgcctactaaattactctaatttatccatatctatgcggcctccgggtcccacgnttcagtgcagcggtctggacagtacttcactctacacaatcagcagcctgcagctagagatgtgggtntttaatnttgacaatagttactttcttagtttacgtttaccgttttaagttccgggacggtacgggtacccgtaagggttcggaagtacgttaaccgaaacggtacgttgggtaggtcctacggacctaccctaagttccttcggttccttacgacctttcccttccccgaactacgtttgtcggtttaacg

SEQ ID NO: 280634 - DNA, 529 bp, Homo sapiens
  misc_feature: GYAE6OF01CTUJO.11.31.C09.1.454.CMB.1.raw
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
  modified_base (503)..(503): a, c, t, g, unknown or other
  misc_feature (503)..(503): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagactactatcttggttccaacagaaaccaggacagcctactaaattactnatttattccacatcatcgcggcctccggggtccccacgattcagtggcnggcgggtctgggacagtactttcactctaccactaatcagcagcctgcagctagaagagtgtggtctttatattgtcaaactatattcttcgtttgtttccgtttaattcgggcgagggaccaagggtgatatacgaacgagtgtacggctagctaccattctagtcttacncttaccgtccccgatagtcctgtacg

SEQ ID NO: 280635 - DNA, 693 bp, Homo sapiens
  misc_feature: GYAE6OF01B9I8W.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctcgtgggcgagagggccaccatcaactgcaaggcaagccagattatttatacagctaccgacagtaagactacttatcttggttaccaaacaagaaaccaggaccagtaccctactaaaattactactatttactccactattctatcggccgggccctcccggggtacccccgaccgtattccgaggtcggcgaggccggtcgtgggaaccagtatttccacgtcctacaactaactcacgtaccaggtccctagcaagtaccgtaggaacgtagttggggttagggtacgtttttaagttagtttacgtactaaaactaagtttactttaacccgtttcttttacggttttacccgtttttaaaggttccggggtacgggtaacgggggtaacctaagggggttacgaacggtaagttaaccgaaacggtaacgttggtacggtaccgtagaaccccgaccttagtttcttcgttccctttactaccgttcccttaccccgtactaacttccgtaaggttaacg

SEQ ID NO: 280636 - DNA, 761 bp, Homo sapiens
  misc_feature: GYAE6OF01DPLWZ.11.31.C09.1.454.CMB.1.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagacttcctattgtatctcgtgggcgaggacgggccaccatcaactgacgaaggcaagccaagtatttattttatacagctccganaagtaagaactacttatcgttagtaccaanaacgaaccagacacgacctactaaattactataattactaccactattctagtcggccgggtcccgtcccggggtaccccacgtaacttcgaaggtcggacgagggtccgggtcgtcgggaactacgtacttccaccgtactacctaacaagtccgagccacgtcccgtagaccaaggtaacctaggaaagttacgttggggttacgggttacgttttaagtttaacgttacggtaacctaaaacgttaatttacttttccgttttaacggttttcggtttttaaccggtttttaacgggtttccggggaaccggggttaaccggggtaaccgtaaagggggttcgggtaaacgtaacggttaaaccgaaacgggttaaacgttcggggttacggaccgtttaccggaccgtaaaccgttactttcggttacgttaccctttccaacccgtttcccccgttaccccgtacctttaacgtccgtttaagttaaacg

SEQ ID NO: 280637 - DNA, 546 bp, Homo sapiens
  misc_feature: GYAE6OF01EA6FS.11.31.C09.1.454.CMB.1.raw
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
  modified_base (530)..(530): a, c, t, g, unknown or other
  misc_feature (530)..(530): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttanacagctccgacagtaagaactacttatcttggttaccaacagaaaccaggacagcctactaaattctctattatccanatctatcgcggcctccggggtccccacgattcagtggcaggcggtctggacagtattcactctacacaatcagcacgcctgcagactagaagntggtggtactttattatgacaactattattctntttacgtttccgtttaattcgggacggaaggtaccgaagggtgaacgacttacaaacggtactggtggacctggaccaccgtattcgtcgttcttacacttccgtacccnctaattcgtagtaacg

SEQ ID NO: 280638 - DNA, 814 bp, Homo sapiens
  misc_feature: GYAE6OF01EKIJ9.11.31.C09.1.454.CMB.1.raw
tcagcgagagataccacgaccggtgctcgatttagacgtctcatcaaggaaggaagggggcagcaagatggtgttgcagacccaggtcttcatttctctgttgctctggatctctggtgccaacggggacatcgtgatgacccagtctccagtacttcctatttgtatctctgggcgaggagggccaccatcaactgacaaggacaacgccagtatttaattttaactacacgtcctaccgaactaagtaaacgtaacttactttattcgtttacggttaccaaacgaacgaaaaccgaaggacaacgtccttacctaaaattacctactaatttacttaccaactatcttagtcggccgggtcccggtaccccggggtacccccgaccggtaattaccgaagggtcggacgacgggtcccggggttacgtacgggggtaaccaaggttaacttttaccgaacctttcctaccgaaacctaaactaccggaacgacctaaacggccctacgggacaaggtaaccttaggaaaggtacgttggggtacggggtttacttttaagtttaagttacgtaacctaaaactaaagtttactttaccgtttacgttttacggttttaacccgttttaaggtttaccgggggacgggtaacggggaaacccgttaaggggtacggtaaacggtacttaacgtaaaaaccggtgttacgggtaccgtcgtaccgtcccgtaaacccttagtttccgttacggtttaccctttaaccgtaccgtttccccctttccccgaacctacgtttaccgtagtaaccg

SEQ ID NO: 280639 - DNA, 632 bp, Homo sapiens
  misc_feature: GYAE6OF01CW2AE.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgacaagtccagcgagacttcttttatatagtgtacaacgataaggacttattagcttggtatacagacaaaaaccgaggacagccctacctaactcgctcactctccgtggcactccgaccggccacccggctccctgacctatcgagtggacgaggcgggtcgtcgggacacgtaccttcactctaccactataccacgacctaaccgtgaccgagggtacctaaggaagtagttcggtacggtactttaagtttttaacttaccgttgtccgtaagtccgttaaggtttacttaggtacggaaaccgtcccgttcccggtcctttacggttaccggtttcgggaccggggtaacgggtaccggtcgggtagaacgtacgtacggaacggaacgtaacggttggcggtacctcggacctaaccgtgtttccgttccg

SEQ ID NO: 280640 - DNA, 664 bp, Homo sapiens
  misc_feature: GYAE6OF01AYW4Y.11.31.C09.1.454.CMB.1.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (380)..(380): a, c, t, g, unknown or other
  misc_feature (380)..(380): n is a, c, g, or t
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtcctccagtacttcctatttgtatctctgggcgagcgggccaccatcaactgacaaggcaagccagtatttatttanacagctccgacagtaagactacttatcttggtaccaanacgaaaccaggacagaccctacctaaaattactactaattttacttacccaacattctagtcggccgggtcccggtcccggggtacccccgaccgtacttcgaggtcggcaggcggtcgnggacacgtatttcactcacaacaagcagcacgcctggacacgacaggtaagtgtagggtgggttacgttttaagttattacgttacaaactaattcgttttacttcgtttacgttttacgtttaacgttttcgggaaccggtaacgggtaaccgtaagggtacggaagtactaacgaaacgttaagtcggtacgggtcctacggaccctacgtaactttcgtcggttaccctttccgtaaccgtttccccgtttacccgacccttgtttcccgtagggttaacc

SEQ ID NO: 280641 - DNA, 750 bp, Homo sapiens
  misc_feature: GYAE6OF01ERLDZ.11.31.C09.1.454.CMB.1.raw
  modified_base (229)..(229): a, c, t, g, unknown or other
  misc_feature (229)..(229): n is a, c, g, or t
tcagcgagagataccacgaccggtgctcgatttagacgtctcatcaaggaaggaagggggcagcaagatggtgttgcagacccaggtcttcatttctctgttgctctggatctctggtgccgaacggggacatcgtgatcgacccagtcctccagtaccttccttattttgtatctcgtgggcgaggacgggccaccatcaactgacaaggcaagcagtatttatttanacagctccgacagtaagaacttacttatcttcggttaccaaacgaacgaaaaccaggaaccacgtaccctaaccttaaattactactaattttacttaccactatctagtcggccgggtcccggtcccgggtaccccgacgtacttcgtaggtcggcacggtccgggtcgtagggacctagtacttaccgtacttcctaccaactaacgtacacgtacgacgtccctaggacctaagtacggtacgaaaggtgttcggggttaggggtttacttttaatttacgtacgttaactaaacgttaactttaagttttccctttacgtttttacggtttttaccgttttaacgggttcgggtacggggaaacggggttaaccgttaaggggttcgggtaaagttaccgtaataaacccgggtacgttgggtaccggtacgttagaaccccgtacgttactacgtttcgttccctttccgtaccctttcccccgtaccgtacccttaacgttccgttggttaaccc

SEQ ID NO: 280642 - DNA, 582 bp, Homo sapiens
  misc_feature: GYAE6OF01AK8GV.11.31.C09.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (512)..(512): a, c, t, g, unknown or other
  misc_feature (512)..(512): n is a, c, g, or t
  modified_base (545)..(545): a, c, t, g, unknown or other
  misc_feature (545)..(545): n is a, c, g, or t
  modified_base (558)..(558): a, c, t, g, unknown or other
  misc_feature (558)..(558): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaatggggacatcgtgatgacccagtctccagaccttcctatttgtatctcgtgggcgaggagggccacatcaactgcaaggcaagccagtattatttanacagctccganagtaacgaactacttatcttggttaccaacagaaaccagacacgcctactaaattctctaatttactccactatctatcggccgggtcccgtcccggggtaccccacgattccgagtcggcaggcgggtctagggactagtactttccacttctacaacaatcacgcacgtccctagactacgactggaatgttgggtgggttactttattacttcgtaacaaactatttcttcgttctttacgtttaccgtttaagtcgggacggtaggacctagggtganaacttacgaaacgtctggtacgcctgacctacnttcctgtccttanccttacccttcccgactgtcgtag

SEQ ID NO: 280643 - DNA, 614 bp, Homo sapiens
  misc_feature: GYAE6OF01EDHAP.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctcgtgggcgagaggccacatcaactgcaaggcaagccagtattatttatacagctccgacagtaagaactacttatcttggtaccaacagaaaccaggacagcctactaattactctattattccacactctatcggccgggtcccgtcccggggtccccgaccgtacgttcaggtcgcgacgggcgggtcgtcggacagtagttcactctacactaatcagcacgctgacagtacgtagaacgtgttggtacgggttacttttattagttcgtaacaaacttattactttccttcggttttacgtttacccgtttaagtttccgggacgggtacgggaacctaaggggtcgtaagactaacgaaacgtacgttgtcggtactcggacctactattcggttactcccgtttcaaccgtttccctaccccgattagtccgttagtacg

SEQ ID NO: 280644 - DNA, 678 bp, Homo sapiens
  misc_feature: GYAE6OF01CKDPD.11.31.C09.1.454.CMB.1.raw
  modified_base (133)..(133): a, c, t, g, unknown or other
  misc_feature (133)..(133): n is a, c, g, or t
  modified_base (263)..(263): a, c, t, g, unknown or other
  misc_feature (263)..(263): n is a, c, g, or t
  modified_base (410)..(410): a, c, t, g, unknown or other
  misc_feature (410)..(410): n is a, c, g, or t
  modified_base (668)..(668): a, c, t, g, unknown or other
  misc_feature (668)..(668): n is a, c, g, or t
tcagcgagagataccacgaccggtgctcgatttagacgtctcatcaaggaaggaaggggcagcaagatggtgttgcagacccagtcttctatttctctgttgctctggatctcgtggtcgaccgaacgggganagtcgtgatcgacccagtcctccagtaccttccttattgtatctgtgggcgaggacggcccaacctatacaacagacgaaggacaaacgccaagtatttaattttacaacacgctaccgaataagtaaanaacttacttattacgttacggtaccaaacgaaacgaaccaggaacacgtacctaactaaattactacttattacctacaatatcgtagcgcggccggtcccgggtacccactactcgacggtcggagacggtcggtacgtacggganaggtcttactaccactacaataatacgagtacacgtccagacaagaactacgaagtagttgggtaggttaactttaattaacgttacgtaaactaaacgtaactttacgtttccttaacgttttacgttttaaccgggttttaaggttaccggggaacgggtaaaccggggtacgtaaagggtaagaataaacgtaacgaaacggtacgtggtacgacgtacaaccgtacctagttctcgtctactactccctaccanacttgagtac

SEQ ID NO: 280645 - DNA, 769 bp, Homo sapiens
  misc_feature: GYAE6OF01EG5E6.11.31.C09.1.454.CMB.1.raw
  modified_base (487)..(487): a, c, t, g, unknown or other
  misc_feature (487)..(487): n is a, c, g, or t
  modified_base (658)..(658): a, c, t, g, unknown or other
  misc_feature (658)..(658): n is a, c, g, or t
tcagcgagagataccacgaccggtgctcgatttagacgtctcatcaaggaaggaaggggcagcaaagatggtgttgcagacccaggtcttcatttctctgttgctctggatctcgtggtcgaccgaacggggacatcggtagatcgacccagtctccagtaccttcctatttgtatctcgtgggacgaggacggaccacatcaactgacgaaggcaacgaccaagtatttaatttacacacgacctaccgaactaaggtaaacaacctttacttaacttcgttacggttacccaaacgtaacgaaaaccgaggacctacgtacccttaacttaaaattcctacttaacttttactccctaaatacttacgttacgtcgggtaccccggggtccccggtaccccggggtacccacgtaacgttccgagggtcgaccgacggtccggtacgaggaacctagtccttacacgttccaacgaactacgacncgacacgtccgtagaccaagacgtagaagtacggttggttacgggttattttagtaagttcgtaactaacgttaattcgtttactaccgttttcgtttttaaccgtaggtttaccggggaaccggttaagggaccggtaagggtggtaaacgtaactaacggttaaaccgnggttacggtcggtacttacgaacccgttacgttaacgttccgtttacgttaccccgttacgttacccgtttaccccgttaccccgtattacgtttacggtaacggttaccc

SEQ ID NO: 280646 - DNA, 753 bp, Homo sapiens
  misc_feature: GYAE6OF01BDVFF.11.31.C09.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
tcagcgagagataccacgaccggtgctcgatttagacgtctcatcaaggaaggaaggggcagcaagatggtgttgcagacccaggtcttcatttctctgttgctctggatctctggtgccgaacggggacatcggtgatgacccagtcctccagtacttccttatttgtatctcgtgggcgaggacgggccaccatcaactgcaaggcaagccagtattatttanacacgcctaccganagtaaagaacttacttatcttgtacccaaacacgaaacaggacacgacctacctaaaattactactattttactaccacatactaactggacccgggccgtccccgggggtccccgaccgtattcgaacggtcggacgtacgggtccgggtcggtaggaacaggttactttcgaaccttccgtacaaactacgttaccgaacgtcccaacggtaccctcgaaccgaacgtaccgtaaggaaacgtacgggtttggtacggggtttaccgtttttaattaagtttacgtacctaaacttaacgttactttcctttacgttttacggttttacccggtttttaacggtttacgggtaacgggtaacgggaaccggttaacggggttaaggtaacgtaacgtaaccgtaaacgttacgtacgggtcgggccttaacggtcccgtaacgttattaccggttcgtttaccgttaccctaacgtttcccctaccccgttacctacgttccgtaggtaacg

SEQ ID NO: 280647 - DNA, 699 bp, Homo sapiens
  misc_feature: GYAE6OF01CG2TG.11.31.C09.1.454.CMB.1.raw
  modified_base (239)..(239): a, c, t, g, unknown or other
  misc_feature (239)..(239): n is a, c, g, or t
  modified_base (413)..(413): a, c, t, g, unknown or other
  misc_feature (413)..(413): n is a, c, g, or t
tcagcgagagataccacgaccggtgctcgatttagacgtctcatcaaggaaggaagggggcagcaagatggtgttgcagacccaggtcttcatttctctgttgctctggatctctggtgccgaacggggacatcgtgatcgacccagtctccagtaccttcctatttgtatctcgtgggacgaggacgggcccaaccatacaactgacgaaggacaacgccgaagtaattttattttanacacgtccgtaccgaactaagtaaacgtaacctttaacgttacttcgtttaccggtaacccaaacgaacgaaaaccgacggactacgtacccttaaccttaaaacttactacttatttacctaccctaactactacgtagtcggcccgggtcccggtcccggggtacccacgtnttcgaggtcggcgagggtccggtgtacggaactacgtacttcacctctacaatactcacgctacgctcgacgagtacgtaggaatggttgggtagtttactttagtcttacgtaactaaacttgtttaccttcgtttactttttacggttaccgttttaagggtcgggtacggaaccgggttaacgtaggggtacgtaagacctaaacggtaacgtagtcgacgtcctacgtaccgacgtattaccgttctacctccgttcctccgttcccattctcggtagttcg

SEQ ID NO: 280648 - DNA, 755 bp, Homo sapiens
  misc_feature: GYAE6OF01AIFFX.11.31.C09.1.454.CMB.1.raw
  modified_base (233)..(233): a, c, t, g, unknown or other
  misc_feature (233)..(233): n is a, c, g, or t
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
tcagcgagagataccacgaccggtgctcgatttagacgtctcatcaaggaaggaagggggcagcaaagatggtgttgcagacccaggtcttcatttctctgttgctctggatctctggtgccgaacggggacatcgtgatggacccagtctccagtaccttcctattttgtatctctgggacgaggacgggccaccataccaaactgacgaagcaagccagtatttattttanacagtcctaccgactaagtaacgaacttactttatcttcggtaccaaacgacgaaaccgaggacacgaccttaacctaaattactactatttactaccactatctatcgcccgggtccgtcccggggcccacgtnttcgaggtcggcgacggcgggtcgtacggacagtacttacgaccttacncctaacaactccgacgacgcgcctagaccgtacgtacgtaggtaagtaggttgggttaacgggtttacttttaacgttaacgtttacgaaccttaaacgtttaaatttccgtttaccgtttccgttttacggttttaaccggtttttaaaccgggtttccggggtaacgggtaaccgggttaaccggtaagggttaacggaagtacgttaaccgggtaaagtaccggttaggaccggttccctaacggtacccggtacctttagtttaccgtacgtttacccgttacgttcccgttaccccgttaccccgtacctaacgtttccgttaaggtaacccg

SEQ ID NO: 280649 - DNA, 830 bp, Homo sapiens
  misc_feature: GYAE6OF01BKFBJ.11.31.C09.1.454.CMB.1.raw
  modified_base (238)..(238): a, c, t, g, unknown or other
  misc_feature (238)..(238): n is a, c, g, or t
tcagcgagagataccacgaccggtgctcgatttagacgtctcatcaaggaaggaaggggcagcaagatggtgttgcagacccaggtcttcatttctctgttgctcgtggatctctggtgaccgaacggggacatcgtgatcgaccagtctaccagtacttccgtattttcgtatctcgtgggacgaggacgggccacactaccaacgtgacaaggcaagcctagttatttaactttanacacggtcctaccggaactaaggtaaacgtaacctaacgtttacgttccgttttacggttaccaaacgaaaccggaaaacctacgggaaccaaccggttacccttaaccgttaaacttacctacttacgttttaactttccaaccgtattaccgttacggttaccggcccgggggtccccgggttccccgggggtaacccccgaccgttacgttaccggtacggtacgggcgtaacgggtccgggtacgggtagggaccgtagttactttaccaccgttactaaccgtaactaactaccgagtccgaacgtccgtacggacgtaggtacctagggtaactagggttcggtaggtttaacgttttagttacgttacgtaactaaagttacttacgtttaccgtttattttcccggtttttaaacgtttacggttacggggacggttaacgggtaaaccggtaggggtaacggtacgtaacgtaaccggtaacggttaacgttcggtacgtacggtaccggtaccctacgttacgttccgttcgttacccttcgtacccttcccggttacctacctacgttacggttgttaccg

SEQ ID NO: 280650 - DNA, 541 bp, Homo sapiens
  misc_feature: GYAE6OF02F875X.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtcccaccgattcagtggcagcgggtctggacagatttcactctcacaatcagcagcctgcagactgaagatggtgggtcgttttattattgtacaactaattatttctctttgtttcccgttttaatttcgggcggtagggtacctaagggttggaagtatacgaaaacgaacttgtaggctgaccaccatctgttcttcacttccttccccgctactctgtacg

SEQ ID NO: 280651 - DNA, 621 bp, Homo sapiens
  misc_feature: GYAE6OF02HWTTK.11.31.C09.1.454.CMB.1.raw
tcagcgagagataccacgaccggtgctcgatttagacgtctcatcaaggaaggaagggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaaacagaaaaccaggacagcctcctaaaattactcatttattccacatctatgcgggcctccgggtccccgaccgattcagtggcagcgggtctgggacagatttcactctcacaaatacagacacgctcgcacgacgtagaagaagtagtgggtcggttagtttaatttagttataactaaactaaattacttacttacgtttacgttttaacgttttacgtttacgggttacgggtaccgggtaacgggtaacggtaaggtaagtaacgtaaacgaaaacgtaaacgtaacggtacgtacgtcgtaccgacctacctacgttacgttccttacttaccttacccgttcccctaccctacctactacg

SEQ ID NO: 280652 - DNA, 578 bp, Homo sapiens
  misc_feature: GYAE6OF02GK2VQ.11.31.C09.1.454.CMB.1.raw
  modified_base (390)..(390): a, c, t, g, unknown or other
  misc_feature (390)..(390): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaattactcatttatccacatctatgcggcctccggggtccccgaccgattcagtggcaggcgggtctgggacagtatttcactctcacaatcagcagcctgcagactgaagngtggtgggtcgttttattagttgtacaactaattatttctctttcgtttaccgttttaagtttcgggacgggtaagggtaaccgtaagggttggaagtagttaacgaaaacgtaacgtggtaggccttagaccgtaaccagttctgtacctttccactttcccgttccccgacctattccgtgtaacg

SEQ ID NO: 280653 - DNA, 581 bp, Homo sapiens
  misc_feature: GYAE6OF02HNB8W.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctacctaaattactcatttatccacatctatgcggcctccgggtccccacgattcagtggcaggcggtctgggacagatttcactctcacatcagcagcctgcagactgaagatggtgggtcttttattattgtacaaactaattattcttctttgtttaccgtttaagtttcgggacgggtaagggtaccctaagggtcggaagtaacgtaccgaaaacgtacgttggtacgggcctacggcctaaccgtattccgttacggttacctttacgactttcccgttaccccggacctattccgtaggtaacg

SEQ ID NO: 280654 - DNA, 528 bp, Homo sapiens
  misc_feature: GYAE6OF02I425I.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatggtgggcgttttattattgtacaataatattctctttgtttcccgttttaatttcgggtcggtagggtacctaagggtggagatcaaacgaactgtggctgcaccatctgtcttcacttccttcccgcctatctgtacg

SEQ ID NO: 280655 - DNA, 535 bp, Homo sapiens
  misc_feature: GYAE6OF02I95R5.11.31.C09.1.454.CMB.1.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (401)..(401): a, c, t, g, unknown or other
  misc_feature (401)..(401): n is a, c, g, or t
  modified_base (460)..(460): a, c, t, g, unknown or other
  misc_feature (460)..(460): n is a, c, g, or t
tcagcgagagataccacgaccggtgctcgatttagacgtctcatcaaggaaggaagggcagcaagatggtgttgcagacccaggtcttcatttctctgttgctctggatctctggtgccaacgggacatcgtgatgacccagtctccagacttcctatttgtatctctgggcgagagggccaccatcaactgcaaggcaagccagacttagtttatacagctaccgacagtaagaactactatctggttccaacagaaccagacagcctactaaatctnatttatccanatctatgcggcctccgggacccacatcagtcggcagcggtcnggacagtattcactcactacaatcagtcacgcctgcagtacctgaacgtatgtaggtctttatatcgtanaacgtattattcgtacttagttccgtttaagttcgacgggagtaccgagtcggtaacgntaccaaagtactgtacgctaggacaaccgtatcgtacgtcttacacgttccctcccgtactacttcgacgttacg

SEQ ID NO: 280656 - DNA, 544 bp, Homo sapiens
  misc_feature: GYAE6OF02IGSL9.11.31.C09.1.454.CMB.1.raw
  modified_base (539)..(539): a, c, t, g, unknown or other
  misc_feature (539)..(539): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccacgattcagtggcagcgggtctgggacagatttcactctcacaatcagcagcctgcagactgaagatgtgggtcgtttattattgtacaaactaattatttctctttgtttaccgttttaaatttcgggacggtaaggggacctaaaggggtcggaagtatacgaaaacgaactggtggctgcaaccatctgttcttcactccttcccgcctattccngtacg

SEQ ID NO: 280657 - DNA, 613 bp, Homo sapiens
  misc_feature: GYAE6OF02G1BLM.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaagacaagccagattattttatacagctccgacagtaagaactacttatcttggttccaacagaaaccaggacacgcctacctaaattactctatttatccacatctatgcggccgtccgggtccccacgtattcagtcggcaggcgggtctgggacagtacttcactctcacaatcagcacgcctgcagactagaagagtggtggtacgtttattattgtactaactaattattacttctttacgtttaccgttttaacgtttacggtacgggtacgggtacgtaagggtaggtagtacgttaacgtaaacgtaaacgtagtaggtcgtacgtccgtaaaaaaaacctcttacgttcgttacctttaccgttacctttcccgtttaccccgtcccgtaccttccgttacgttaaccg

SEQ ID NO: 280658 - DNA, 520 bp, Homo sapiens
  misc_feature: GYAE6OF02JCNOX.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctcctaaattactcatttatccacatctatgcgggcctccggggtccccgaccgattcagtggcagcgggtctgggacagatttcactctcacatcagcagcctgcagactgaagatggtgggcttttattattgtacaactaattattctctttgtttccgtttaatttcggcggtaggtaccagggtgagatacgaaacgatgtggctggcaccatcgtgtcttcattccgttcccgcattctgtacg

SEQ ID NO: 280659 - DNA, 546 bp, Homo sapiens
  misc_feature: GYAE6OF02HAO3P.11.31.C09.1.454.CMB.1.raw
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtccccagatatcctgcctgtgtctctgggcgagagggccaccatcgagtgcaagtccagcgagactcttttatatagtgtcaacgataaggactatttagcttggtatcagacaaaaaccaggacagccctacctaaactgctcatctcctgggcatcctaccgggcacccggagtccctgaccgattcagtgcngcgggtctgggacagacttcactctcaccatcagccaacctgcacggctagaangtgtcgntagttttattactgtcagctagttattgtagaacgtccttccgcttacgtaccgtttcggggcgacggggaccgtcgggtaggacgtatccgaaggaccgtaacgtggttcggccgtgacccgaacccgtattcccgttgttaccg

SEQ ID NO: 280660 - DNA, 547 bp, Homo sapiens
  misc_feature: GYAE6OF02HWKKE.11.31.C09.1.454.CMB.1.raw
  modified_base (323)..(323): a, c, t, g, unknown or other
  misc_feature (323)..(323): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaaacagaaaccaggacagcctacctaaattactcatttatccacatctatgccggcctccgggccccacgnttcagtgcagcgggtctgggacagatttcactctcacaatcagcagcctgcagactagaagatggtgggtactttattattgtacaaactaattattcttctttgtttccgtttaatttcggcgggtaagggtacctaaggggtgaagtatacgaaacgaactggtgactgaccaacctattctgttccttacgacttcccttcccgcctaattccgtgtaacg

SEQ ID NO: 280661 - DNA, 826 bp, Homo sapiens
  misc_feature: GYAE6OF02J05Y9.11.31.C09.1.454.CMB.1.raw
  modified_base (479)..(479): a, c, t, g, unknown or other
  misc_feature (479)..(479): n is a, c, g, or t
tcagcgagagataccacgaccggtgctcgatttagacgtctcatcaaggaaggaaggggcgagcaagatggtgttgcagacccaggtcttcattctctgttgctctggatctctggtgccaacggggacatcgtgatgacccagtctccagacttcctatttgtatctcgtgggcgtagtcggccctacatcaactgacaaggcaagccaagtatttaactttataccgagtcctaccgaactagtaaacgtacttacttattccgttacggtaccctaaacgacgaaaccgtaggactacgaccttaccgtaaaattaccgtcttaattttaacctaccaacgtactactttaagtccggaccgggttacccctacccccggggggttacccccgtaaccggttacttacgtacggtacggaccggtaccgggtaccgggttcgtacgggaactaacgtccttttaccaccgtttacnccaaacgtactaccgacgtcgaccgtacttaccgagaaccggtactaacgggtaagtacggtacggttcgggttaacgttttacgtttacgtacggttaaactaaacgttaactttacgtttacgtttaccgtttacggtttaccgtttaacggttccgggttaaccggggtacgtaaaccccgggtagggttacgggacgtttaaacggtaacctaaaccgggtaactcgggtttacggaccttacggtcccgtaaacccgttacgttgttaaacccggttcctttaccgtaacccttttcccgggtaccccgtaaccgtttccgttaacggttaccgttaacccg

SEQ ID NO: 280662 - DNA, 852 bp, Homo sapiens
  misc_feature: GYAE6OF02JA357.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatcgacccagtctccagtaccttcctatttgtatctcgtgggcgaggacgggccaccatcaactgacgaaggcaacgccaagtatttaattttcggaacttacgacgtaccgaccgaagtaaacgtaaacgttaacttacttacgttacgttaccgtaaaccgaaacgaaacgaaaccggaacgaaccgtccctaaaaacgttaaacttccccaaatttaacttttacccaacccttaaattaccttacctaagtccgggtaacccgttcccggttccccggggggaccccctacggggttacccctaccggtaagggttccgaacggtacggggtccgtaggacgggacctagggtacctacgactttcacgaaactactacgaactaccacgtcctagaccgtacggtacgaaggaaacgttggtagggtacggtttaacgtttaaggttcggtttacgtaaacttaagttactttaaccttaactttacgttttaccgttttaccgtttttaacgggttcccggggttaaacgggttaaccgggtaaacgggtttaagggggaacctaacgggttacggtaaaaccggaaaacgttcggttaacgggaacttcggttaacggtaccccttaaggtaccttaccgtacgtttacctttaaccggtccgttttacccccgtaaccgtacctttacccggtccggtaagttaaccg

SEQ ID NO: 280663 - DNA, 579 bp, Homo sapiens
  misc_feature: GYAE6OF02GDDFV.11.31.C09.1.454.CMB.1.raw
  modified_base (217)..(217): a, c, t, g, unknown or other
  misc_feature (217)..(217): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttanacagctccgacagtaagaactacttatcttggttccaacagaaaccaggacagcctacctaaattactcatttattccacatctatgcggcctccggggtccccgacgattcagtggcagcgggtctgggacagatttcactctcacaatcagcagcctgcagactgaagatggtggtcgtttattattgtacaactaatatttcttctttcgtttaccgttttaagtttccggagggtacgggtaccgtaagggtaggtaagattaccgtaaacgaacgttgtcggtactcggtaccaaccgtattccgtcgttctttacgactttcccgttaccccgaccctaacgttccgtaggtaacg

SEQ ID NO: 280664 - DNA, 632 bp, Homo sapiens
  misc_feature: GYAE6OF02F806V.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtcctccagacttcctatttgtatctctgggcgagagggccaccatcaactgcaaggcaagccagatttatttatacagctccgacagtaagaactacttatcttggttaccaacacgaaaccaggacagcctactaaattactctatttatccacatctatcggccgggtcccgtccggggtccccgaccggtacttcgagtcggcaggtcgggtcgtgggactagtactttccaccttctcaacaatcaagcagcctgacagactgaacgagtggtgggtcttttaagttattcgtaactaaactaattactttcttactttcgtttaccgttttaagttccggggcgggaagggtaccgtaaggggtcggtaacgtaacgttaaccgaaaacggtacgttaggtacgggtcttacggaccctaacctagttccgttacgtttccttacgaccgttccccttcccggcttaacttcgtacggtaacg

SEQ ID NO: 280665 - DNA, 607 bp, Homo sapiens
  misc_feature: GYAE6OF02I9UB2.11.31.C09.1.454.CMB.1.raw
  modified_base (217)..(217): a, c, t, g, unknown or other
  misc_feature (217)..(217): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttanacagctccgacagtaagaactacttatcttggttccaacagaaaccaggacagcctacctaaattactcatttatccanatctatgcgggcctccggggtccccgacgattcagtggcagcgggtctgggacagtattccactcncacaatcagcagcctgacagtactagaagngtgtgggtactttagttacttgtacctaacgtaatttagttccttcgtttacgtttacccggtttttaagtttccggggacgggtaacgggtacccgtaaggggttcggtaaggtaacttacgaaaaccggttacgtggtacgggcttacggaccgtacacgttcgttacgttaccttagtaccttcccgttaccccgcctacttccgtagtacg

SEQ ID NO: 280666 - DNA, 720 bp, Homo sapiens
  misc_feature: GYAE6OF02F3BU1.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttaccaacagaaaccaggacagcctacctaaattactctatttacttccaacattctatggccggcccgtcccggggtccccacgacttcaggtggcgaggccgggtctgggacagtactttcactctacaacaactcacgacctacgccctaggaccaagtaactacggaaagagtttcgggttacggggtacttttttaattacgttcggttaactaaacggttaaatttacgttttctttaccgtttacggttttacccgtttttaaacggtttccgggacggggtaacgggttaccgtaaaagggggtttcggaacgttaaccggttaaaccgaaaacggttaaaccggttagggttaccggtacgttaccggacctaaacccgttagttacccgttcggtttcctttaacccgtaccgtttccccgttaccccccggctttaacccgttcgttggtttaaacccgg

SEQ ID NO: 280667 - DNA, 685 bp, Homo sapiens
  misc_feature: GYAE6OF02FS34W.11.31.C09.1.454.CMB.1.raw
  modified_base (219)..(219): a, c, t, g, unknown or other
  misc_feature (219)..(219): n is a, c, g, or t
  modified_base (348)..(348): a, c, t, g, unknown or other
  misc_feature (348)..(348): n is a, c, g, or t
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagacttcctatttgtatctcgtgggcgagagggccaccatcaactgcaaggcaagccagatttatttanacagctccgacagtaagaactacttatcttggttccaaacaagaaaccaggacacgacctacctaaattactactatttactccacatctatcggccgggcccgtcccgggtcccgaccgtattaccgngtcggacgaggtcgggtctacgggacagtacgtttacacgtctacaacgaactcaacgcacgccgtagacaacgtactaggaaagtacgttgggtaggggttacgttttaaatttacgttacgtaactaaacgttaacttaagttttcccttacgttttacggttttaacccgtttttaaggtttcccggggaagggtaacggggtaaccgtaaagggtttgggaaacgtactaaaccggaaaacgtacgttggtacgtcgtacgccgtaacgaccttacgtacgtttccttaccgttacgttcccgttccccggtaacctcgttacgtacgtaacg

SEQ ID NO: 280668 - DNA, 608 bp, Homo sapiens
  misc_feature: GYAE6OF02H665O.11.31.C09.1.454.CMB.1.raw
  modified_base (255)..(255): a, c, t, g, unknown or other
  misc_feature (255)..(255): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcggtgatgacccagtctccagacttcctattgtatctctgggcgagagggccacatcaactgcaaggcaagccagattattttatacagctccgacagtaagaactactatcttggttccaaanagaaaccaggacacgcctactaaattactactatttatcactatctatgcggtcctccgggcccacgtatcagtggcaggcgggtctaggactagtacttcactctacaacaactcaagcacgcctcgcagactaggaaagagtgggtagggttctttaagttacttgtaacaaaaccgtaatttatttccgtacttttgtttaccgttttaaaggtttccgggaacgggtaacgggacctaaagggtggaacgtaataccgaaaacgtacgttggcggtacttcggacctaaccgtattccgtacgtttccttactacgtttccctttcccgacctactttcggagttaacg

SEQ ID NO: 280669 - DNA, 592 bp, Homo sapiens
  misc_feature: GYAE6OF02FSUR2.11.31.C09.1.454.CMB.1.raw
  modified_base (410)..(410): a, c, t, g, unknown or other
  misc_feature (410)..(410): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttatccacatctatgcggcctccggggtccccgaccgattcagtggcagcgggtctgggacagatttcactctcacaatcagcagcctgcagactgagatgtgggcttttattatgtacaaanaatattctcttcgtttaccgttttaatttccgggcggtaacggggtaccctaaggggttggagtactacaaaacggtaacttggtacggcttaggcctaaccctaagttcccgttaggtttacccttttaccgtaactttccccgtttaccccccgacctaacttcccgttaggtaaaccgg

SEQ ID NO: 280670 - DNA, 732 bp, Homo sapiens
  misc_feature: GYAE6OF02HCZI2.11.31.C09.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctcgtgggcgaaggacgggccaaccatcaaactgacaaggcaagccagtaattattttanacagctaccgacagtaaanaacttacttatcgttaggttaccaaacacgaaaaccaggacacgccttacctaaattactctaatttactaccanatctagcggccggtaccttcccggggccccacgacttcaggtcggacaggcgggtctaggacacgtatttaccacctactacaacgaaactccgaagccaacgccgtagaccaagtacctaggtaaagtagtacggttcgggttacgttttaattaagtttcgtaaactaaaaccgtaaagttttaactttcgttacttttacgttttaaccggtttaaagttttccggggacggggtaaacggggttaaacccgtaaagggggttaggtaacgtaaacgttaaacccgtaaaaaccggtacttacgggtacgggtaccttacggaaccctaaccggtaacttccggttacgttaccgtttacctaccttaccccggtttacccgacccttaacgtttacctaggttaaccg

SEQ ID NO: 280671 - DNA, 687 bp, Homo sapiens
  misc_feature: GYAE6OF02HZDJ6.11.31.C09.1.454.CMB.1.raw
  modified_base (409)..(409): a, c, t, g, unknown or other
  misc_feature (409)..(409): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctcgtgggcgaggagggccaccatcaactgcaaggcaagccagattattttatacagctccgacagtaagaacttacttatcttggttccaaacagaaaaccaggacagcctcctaaaatactctatttatccaacatctatgccggcctcccgggtcccacgtattcgagtcgcagggcggtcgtggactagtactttcactctaccaactaatccaagccagcctgacagactaggaaagnttaggtggggttacttttaattattcgtaacaaaacgtaatttacttccgttatttttcggtttaaccgttttaacggtttcggggccgggtaaacgggtaacccgtaaaggggttgggaaacgtaacgtttaacccgaaaaaacggttacggttacgggttcgggtaccttaccgggaacctaaacccccgttaattcggtttaccggtttaccctttacggttaacctttcccccggtttaccccccgtaacttagtttccccgttaggttaaacg

SEQ ID NO: 280672 - DNA, 211 bp, Homo sapiens
  misc_feature: GYAE6OF02IJT3V.11.31.C09.1.454.CMB.1.raw
  modified_base (198)..(211): a, c, t, g, unknown or other
  misc_feature (198)..(211): n is a, c, g, or t
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatcgacccagtctccagacttccttatttgtatctcgtgggcgagagggccaccatcaactnnnnnnnnnnnnnn

SEQ ID NO: 280673 - DNA, 609 bp, Homo sapiens
  misc_feature: GYAE6OF02IZGQQ.11.31.C09.1.454.CMB.1.raw
  modified_base (437)..(437): a, c, t, g, unknown or other
  misc_feature (437)..(437): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtcctccagacttcctatttgtatctctgggcgagagggcccaccatcaactgcaaggcaagccaagtatttattttatacagcctaccgacagtaaagaactacttatcttggtaccaacagaaaccaggacagcctactaaattactctatttactccaactatctagtcggccgggtcccgtccccggggtcccccgaccgtacttccgaggtcggaccagggccgggtctagggaccagtactttccacttcctacaacaatcagccgagcccgtgacagactaggaagngtggtaggtacgttttaagttagttagtaccaaactaattactttctcgtttgtttacccgtttaagttcggacgggtaaggaccgtaaggtgtagactaacgaaacgacgtgtacgctagaccacgtactcgtgttacttacgtactccgttccccactacttcgtgtacg

SEQ ID NO: 280674 - DNA, 649 bp, Homo sapiens
  misc_feature: GYAE6OF02GDESI.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagcagatttattttatacagctccgacagtaagaactacttatcttggttccaacagaaaccaggacagcctacctaaattactacattttatccacatctatcgcggtcctccggggtccccgacgacttcagtggcaggcgggtctgggacagtatttcactctacacaactcagcacgtcctgcgaagtactagaagtagttggtagggttacgttttaatttaacgttcgtactaaactaaatttacgtttacttaccgttttgttttacccggtttttaacgtttccggggtacgggtaagggtaaccgtaaggggttacggaaggtaacgtaacgtaaaaccggtaacgttggtacggtcgtacgaccgtaacctcttacgttggtttacctttccgacgtttccccgttaccccggtacctaacgtccgttaacgttaacg

SEQ ID NO: 280675 - DNA, 850 bp, Homo sapiens
  misc_feature: GYAE6OF02HK3BS.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatcgaccctagtcctaccagacttcctatttgtatctctaggcgagacggccacatacactgacaagcaacgccagtacttatttactacacgctaccgactagtaacgtaacttacttatacgttcggttacccaacgtaacgaaaccgacggaacaacgtacccttaaccttaaaattacctacttaattttaaccttaccaaccttaattccttaagtccgggtacccgggtccccggttacccccggggggttacccccgaaccggttactttacggacggttacgggaccggttaacgggtccgggggttaccgtaacggggtaacccgtaaggtttacttttacccggacctttaccgttaacaaacgttaactacgtacgaccgtaccggtcctttacgacctaaccggtagtacggtaaacgttaggttacgggttacggggtttactttttaagttaacgtttaaccggtaacctaaacgttaactttaccgtttaccttttacgttttacggttttaccgttttaaacgggtttcgggaaccggggtaacggttaacccgggtaagggttacggtaacgttaacgtaaacggtaaacccgtagtttcgggacgtcggttagtcccgtaacgtacgttcgttacctttacgttacccgttaccgttccccgtaacccggttcctaacgtttccgtaggttaacccg

SEQ ID NO: 280676 - DNA, 754 bp, Homo sapiens
  misc_feature: GYAE6OF02JL0MH.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcggtgatgacccagtctccagacttcctattgtatctctgggcagaggccaccatcaactgcaaggcaagccagtattattttatacagctccgaacagtaagaacttacttatcttggttaccaacagaaaccagtacagacctactaaattactcgtaatttacttacccacacttcgtaagtcggccgggtaccctaccccgggggtaccccaaccgtacttcgaacgtcggacgacgggtccgggtcgtacgggacctaacggttactttacgacctacctacgtaaacctaagttcccgtaaggtaccaccggtaccgttacgaccgtaacggtaacctaagggtaaacgtaagtcggggttacgggttacttttaacgtttaagtttacggaacctaaacggttaaattttaaaccgttttcgtttccggttttaaacggtttttacccggttttaaacggtttaccggggtaaccggggttaaacggtaacccgggttagggttaacggtacggtaaacttaacccggaaaagttaacgtcgggtacgtacgttacgaccgtaacctatcgtaccgttctacgtaccgttccttaccgacctacgttctaggtaac

SEQ ID NO: 280677 - DNA, 683 bp, Homo sapiens
  misc_feature: GYAE6OF02HJIHT.11.31.C09.1.454.CMB.1.raw
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagaccttcctatttgtatctcgtgggacgaggacggccacagtacaactgacaggcaagcagatttattttanacngtctaccgacaagtaaagacttaacttatcgttagttaccaacgacgaaaccagacagtcctactaaacttctactatttactccaatacttcgtatcggaccggtccgtccccggggtacccctacgtacttcaaggtcgacagggtccggtcgtaggaccaggtctttacgaccttctacaataacgtacgacaccgtacgccgtgactaacgtacgtacgaagtacgtgggttacggttcgttttaagttacgttcgtaacctaaattaacgtttactttacttcgttttacgtttacccgttttaaggttaccggagggtacggtaccgaaggttgaaggtactaaaccgaaagttaactggtacgcgtacgtaccaaccgttacgttcgttaacgttaccctttacgtaccgttccccgtttaccgaccgtttattcccgggttattacccgg

SEQ ID NO: 280678 - DNA, 732 bp, Homo sapiens
  misc_feature: GYAE6OF02G3XGY.11.31.C09.1.454.CMB.1.raw
  modified_base (101)..(101): a, c, t, g, unknown or other
  misc_feature (101)..(101): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (399)..(399): a, c, t, g, unknown or other
  misc_feature (399)..(399): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagcgagagataccacgaccggtgctcgatttagacgtctcatcaaggaaggaaggggcagcaagatggtgttgcagacccaggtcttcattctctgttnctctgatctctggtcgccgaacggggacatcgtgatcgaccctgtcctccagtaccttcctatttgtattctcgtgggacgaggacgggacccaccatacaactcgacaaggcaacgccgaatatttaattttacaccgtagcccttaccgaanaaggtaaacgtaacttaacttattcgtttacgtacctaacgaaacgaaaccnggtaacncgtacctacctaaaattctacctattttactaccactacttcgtacgtcggaccggtcccgtccccgggacccgtaccattacgnggacgcgacggtcgggtcgtaggacgtatacttcacttcgacaanacnctagccacgtcccaggccgtacgtacgtagaaacgtggttcgggttacggggttacttttaaagttacgttacgtaaccgttaaactagttttaacctttcgtttaccgttttacggttttaccggtttaggttttacccggggtacggtaaacgggtaccggtaagggtacggtaacgttaacgtaaccgtaaaacgtagttacgggttaggccttacgtaccgtaacctagttacccgttgtacccttagtccctacgttacccgtactacgtcgtacgtacg

SEQ ID NO: 280679 - DNA, 724 bp, Homo sapiens
  misc_feature: GYAE6OF02H2355.11.31.C09.1.454.CMB.1.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgacaaggcaagccagattatttatacagctccgaacagtaagaactacttatcttgtccaacagaaaccaggacagcctactaaattactctatttatccactatctagtgccgggtccgtcccggggtaccccgaaccgtatttcgacggtggccgacggtccgggtcgtcgggacagttacttccactttcctacaacctaatcagaccgtacgccttcgacgacgattaggaaacgtaggtacggttcgggttagtttttaacttaacgttcgttaaccaaacgttaaagtttacttttacccttaccggtttttcggtttaacccggtttttaaacgtttccggggtaaccggggttaaacgggtaacccggtaaagggttaacgggtaaggtaaccgtaaacgtaaaaacccggtgtttaggtaccgggtactcggtaaccgtaacccaagttccgttaacggtttacccttaccgttaccttaccccgtttcccccgtaccttaacgtttcccgagttaacccgg

SEQ ID NO: 280680 - DNA, 764 bp, Homo sapiens
  misc_feature: GYAE6OF02I7UUR.11.31.C09.1.454.CMB.1.raw
  modified_base (164)..(164): a, c, t, g, unknown or other
  misc_feature (164)..(164): n is a, c, g, or t
  modified_base (222)..(222): a, c, t, g, unknown or other
  misc_feature (222)..(222): n is a, c, g, or t
  modified_base (473)..(473): a, c, t, g, unknown or other
  misc_feature (473)..(473): n is a, c, g, or t
  modified_base (500)..(500): a, c, t, g, unknown or other
  misc_feature (500)..(500): n is a, c, g, or t
tcagcgagagataccacgaccggtgctcgatttagacgtctcatcaaggaaggaaggggcagcaagatggtgttgcagacccaggtcttcatttctctgttgctctggatctcgtggtgccacggggacatcgtgatcgaccagtctccagacttcctattgtntctcgtgggcgagacggccacatcaactgacaaggcaacgccaagtatttaatttaanacacgacctacccgaacagtaaacgaactttacttattacttcggttaccaacaacgaaaccacgggaaccacgtacccttaccttaaaacgttactaccttaactttaacttccctaactattaccgtaacgtcggacccgggtccccggtacccccggggtccccgtaaccggacttacgtaggtcggaccgtacggtccgggtctacgggacacgtatttccaacctcctacgaactaactcgtaacnccgaccgtctccgacgtcgtaaaccgnggtaaagtcggttacggttcggttatttagttacgttagaaccttaaacttacgtttccgttttaccttccgtttaagttttacccggttttaagggttcgggaaccgggtaacggttacggttaaggtaccggtaacgttaaacgtaaccggtaaacgtacgggttcggtaacgtccgttaccgacccgtaacttaccgttacggttacttacccgttaaccgttcccgttacccgttaccctagtaacgttcgtacgtaacc

SEQ ID NO: 280681 - DNA, 642 bp, Homo sapiens
  misc_feature: GYAE6OF02FVDBH.11.31.C09.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (352)..(352): a, c, t, g, unknown or other
  misc_feature (352)..(352): n is a, c, g, or t
  modified_base (412)..(412): a, c, t, g, unknown or other
  misc_feature (412)..(412): n is a, c, g, or t
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctcgtgggcgagagggccacatcaactgacaaggcaagccagtatttatttanacanctccganagtaagactacttatcgttgttaccaacagaaacaggacagcctactaaattactactatttactccatatctagtcggccggtcccgtcccggggtaccccgacgtacttcgaggtggacnggtcgggtctgggacagtatttccacttcacactaatcagccagcctgcagactgaagtntgggtggtactttattagtcgtacaaacttattacttcgttctttacgtttaccgttttaagttccggggaacggtacgggtaacccgtaagggttggaacgttaacgtaaaccgtaaaacggttaccgttagggtccgtcgttacggacccgtaaccgttacgttacgttccgtttacccgttacttaccgttcccttacccccggatacgtttccgtaggttaacccg

SEQ ID NO: 280682 - DNA, 191 bp, Homo sapiens
  misc_feature: GYAE6OF01AF05B.1.61.F06.1.454.CMB.1.raw
  modified_base (189)..(191): a, c, t, g, unknown or other
  misc_feature (189)..(191): n is a, c, g, or t
tcagacgagtgcgtcacgaccggtgctcgatttagctacgctctaagggaaagggtgagatccctcactttggctcactttcggcggagggaccaaggtggagatcaaacgaactgtggctgcaccatctgtcttcatcttcccgccatctgaacgcactcgtctgagcgggctggcaaggcgcatagnnn

SEQ ID NO: 280683 - DNA, 191 bp, Homo sapiens
  misc_feature: GYAE6OF02IOX6O.1.61.F06.1.454.CMB.1.raw
  modified_base (189)..(191): a, c, t, g, unknown or other
  misc_feature (189)..(191): n is a, c, g, or t
tcagacgagtgcgtcacgaccggtgctcgatttagctacgctctaagggaaagggtgagatccctcactgtggctcactttcggcggagggaccaaggtggagatcaaacgaactgtggctgcaccatctgtcttcatcttcccgccatctgaacgcactcgtctgagcgggctggcaaggcgcatagnnn

SEQ ID NO: 280684 - DNA, 603 bp, Homo sapiens
  misc_feature: GYAE6OF01BWCDW.36.14.B03.1.454.CMB.1.raw
tcagtacgctgtctcacgaccggtgctcgatttagtgtgagtagtttgagtctgggggaggcttggtccagccgggggggtccctgagactctcctgtgtagcctctggattcacctttaacaactactggatgtcctgggtccgccaggctccgaggggaaggggctggaatgggtggccaacatgaagccagatggaagtcagacatactatgtgactctgtgaagggccattcaccatctccagagacagcgccaatcactcactgtatctgacaaatgaaacagcctgaagacgaccgaaagaccacggtcttaggtttaattactgtgacgagaggacggcttacgtttggagttgttatcgtccctttgactcgtcggggccacggaccctggtcctccgtctcctctcgtcctccaccgacggccctactcccgtcccttccccgtcggcccgtcccgtcgccgtacccgacggacgcccacccgtaccgacgacgaccgaaacgcccggcccgtacgggcctcgtccgtacggtaccgaacggtaccttacctaccgacgaccacggtaccgtacgcggaggcggcgtcggacgg

SEQ ID NO: 280685 - DNA, 603 bp, Homo sapiens
  misc_feature: GYAE6OF01C4AN4.36.14.B03.1.454.CMB.1.raw
  modified_base (329)..(329): a, c, t, g, unknown or other
  misc_feature (329)..(329): n is a, c, g, or t
  modified_base (452)..(452): a, c, t, g, unknown or other
  misc_feature (452)..(452): n is a, c, g, or t
  modified_base (584)..(584): a, c, t, g, unknown or other
  misc_feature (584)..(584): n is a, c, g, or t
tcagtacgctgtctcacgaccggtgctcgatttagtgtgagtagtttgagtctgggggaggcttggtccagccggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccgattcaccatctccagagacagcgccaatcactcactgtatctgacaaatgaacagcctgagacgcgaagacacggcttgtttatactgtgcgagaggnggctacgttttggagttgttagtcgtccctttgacttacgtcggggcccagggtacccctggtcctccgtctccgtctcgtccttccgaccgaacggccctacttcccgtccctttcccccgnggtcccgacccgtcgccgttcccgaggacgccgacccgtaccgacgacgtccaccgacggcccgcccgtgggtcctggcccttgggtaccgaacggtaccctaccgttccgacgaccgacgtccggttaccnggacggccgggcgtacggg

SEQ ID NO: 280686 - DNA, 562 bp, Homo sapiens
  misc_feature: GYAE6OF01E4CAY.36.14.B03.1.454.CMB.1.raw
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
  modified_base (540)..(540): a, c, t, g, unknown or other
  misc_feature (540)..(540): n is a, c, g, or t
  modified_base (556)..(559): a, c, t, g, unknown or other
  misc_feature (556)..(559): n is a, c, g, or t
  modified_base (562)..(562): a, c, t, g, unknown or other
  misc_feature (562)..(562): n is a, c, g, or t
tcagtacgctgtctcacgaccggtgctcgatttagtgtgagtagtttgagtctgggggaggcttggtccagccgggggggtccctgagactcctcctgtgtagcctctgaacttccccctttacggcttattggatgagctgggtccgccaggctccgagggaaggggctggagtgggtggccaaacataaaagcaaagatgggaagtagggagggagtatgtggaatctgtgaagggccgtttcaccatctccagagacaacgccaagactccgtgcatctgcaaatgaacagtctgagagccgaggacacggctatttatactgcgcgagagaaggcgtgggcggtttacactacgtggggccaggaaccctggtcaccgtctccctcacgccctccaccaacggcccagtccgtcccttccccgcggccgccctgccctccgacggagccaccgtccgagacgcaccgaggcccggccctcgggctcggccgtcggtaccgaaaggtcctacgttccagacngcgtacngaggcggngtaggcgaggcgcagnnnnggn

SEQ ID NO: 280687 - DNA, 728 bp, Homo sapiens
  misc_feature: GYAE6OF01DA5V9.36.14.B03.1.454.CMB.1.raw
  modified_base (328)..(328): a, c, t, g, unknown or other
  misc_feature (328)..(328): n is a, c, g, or t
tcagtacgctgtctcacgaccggtgctcgatttagtgtgagtagtttgagtcgtgggggaggcttggtccaggccgggggggtccctgagactctcctgtgtagcctctggattcacctttaacaactactggatcgtcctgggtccgccaggcctccgaggggaaggggctagggaagtggggtcggacccaaacatgaaagccaagatggaagtcagacatactatggtggactctggtaggaacgggccattccaacctatcctccaagacgacacggaccaccaaatccaactcacctgtactcgtagacaaaagtcgaaaccngtacctaggaacgaacgacccggaaagtaccgaccggtcttagttttaactacgtgtacggacgaaggaaggtcgggtaccttacggttttagggacggtttggtttaacctcggtacccgttttagaccgttacggtcggggaccctaacgggtaccctggtccctccgtctccgtctcgtcctaccgaccgacggtccctacgtcccgtccttccccgtcggtccctacccgtcgtaccgtccgtacggaccgcctaacccgtaccggacgaacgaccgtaccgccgtacccggtccgtccggtactccggtacccgtacggtaaccgtaaacggttccctaaccgttccgaacgacgtacggtaccgtaacgtgggaaccggtcgggtcgtaccggg

SEQ ID NO: 280688 - DNA, 899 bp, Homo sapiens
  misc_feature: GYAE6OF01BKKW5.36.14.B03.1.454.CMB.1.raw
  modified_base (185)..(185): a, c, t, g, unknown or other
  misc_feature (185)..(185): n is a, c, g, or t
tcagtacgctgtctcacgaccggtgctcgatttagtgtgagtagtttgagtcgtggggggaggcttggtccaggccggggggtccctgagactctcctgtgtagcctctggattcacctttaaacaactactggatgtccgtgggtccgccaggctcgagggagggctggaagtgggtgaccaanatgaagccagagtggaagtcaagacattactagtggtagactcgtggtaggaacggggcctaattccaaccattccaccgagaagaccagccgaccaatcctaactcacgttgtaactcgagaactaaaagtgaaacgcggtaccgtaggaagaaccggaaccggaaaggtacccgaacggttcttttaggttttaaacttttagtcggttactaaccgtttaaacggttttacggggttaatttaacggtaccggaaccgtaacggaccgtaagtaaacgggtcggggaaccccgttaaaccgggtaacccgtcggtacccgtacccgttaccgtaccgtaccgacgtaccccgtaaccccgaaacccgggaacccggggtacccttaacccggttaccccggttttccccccgttaacccccccgggtaccgggtccccggtcccccgttacgggtaccccggttaccccggtaaaccggtacccgtaacccccgttaaaccccgtacccggggaaaccgtaaccggaacccgaacccggggtacccggaccccggggttcccggtcgggttacccctcccgggtttaaccgtaccgggtaaacccgaaaacggttaccctttaacccgtacccgaacggtaaccgacgggtaaccgttaacggacgggtaccgggtacccggggttacaccggggtaaacgcggtcgaacg

SEQ ID NO: 280689 - DNA, 742 bp, Homo sapiens
  misc_feature: GYAE6OF01EXEOI.36.14.B03.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagtacgctgtctcacgaccggtgctcgatttagtgtgagtagtttgagtcgtgggggaggcttggtccagccggggggtccctgagactctcctgtgtagcctctggattcacctttaacaactactggatgtcctggtccgcgaggctcgagggaagggctggaagtgggtcggaccaatagtgaacgccaagtagtggaagtcaagacatatagtgtagcttacgngtaggaaggggccctattccgaaccctattccgtaccaaggaagtaccaaggccaacctaatccaacttcaacgtntaagttctagacaaaatagaacagtacctacgagacggaccggaaagtaccgacggttacgttagttttaattacgtgttcggacggaaggagaggtaccttagtttggagtttgtattcgtccttgtaaccgttggtacggaccggaacgggtaaccgtgtccgtaaccgttccgtactcgtaccgccgtaacccgaaccgaacggaccctagttaccggttccccttaccccgtcggacccctaccttaccctaaccgaagtaccgactaacccgtcgggttacggggacctacgaccggtacccggtcccggtacggcgtacccgtggttacccggtaacgaacggttaaccgtaccccgttaccgtaacgaaccgtacccgggtacttaaccggtcggagggaccccgggagtcgggaaaccgtaacccggg

SEQ ID NO: 280690 - DNA, 256 bp, Homo sapiens
  misc_feature: GYAE6OF02HRWYB.36.14.B03.1.454.CMB.1.raw
  modified_base (256)..(256): a, c, t, g, unknown or other
  misc_feature (256)..(256): n is a, c, g, or t
tcagtacgctgtctcacgaccggtgctcgatttagtgtgagtagttcgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatagn

SEQ ID NO: 280691 - DNA, 576 bp, Homo sapiens
  misc_feature: GYAE6OF02F35YN.36.14.B03.1.454.CMB.1.raw
tcagtacgctgtctcacgaccggtgctcgatttagtgtgagtagtttgagtctgggggaggcttggtccagccgggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccattcaccatctccagagacagtgccaataactcactgtatctgacaaatgaacagcctgagagccgaagacacggctgtttattactgtgcgagagagggctacgttttggagttggttatgtccctttgactacgtgggccagggaccctggtctccgtctcctctcgcttccaccgaggcccatcccgtccttccccctggcccgccctcgcctccgacgacgccaccgtccgagacgccacgacgcccgcctgacgtcgtcgtccgtcggtacgaacggtaccttaccgttacccgacgaaccgacggtccgttaacgtcgggacggtccgggcgtacgggg

SEQ ID NO: 280692 - DNA, 694 bp, Homo sapiens
  misc_feature: GYAE6OF02J13F6.36.14.B03.1.454.CMB.1.raw
  modified_base (304)..(304): a, c, t, g, unknown or other
  misc_feature (304)..(304): n is a, c, g, or t
tcagtacgctgtctcacgaccggtgctcgatttagtgtgagtagtttgagtctggggagggcttggtccagccggggggtcccgtgagactctcctgtgtagcctctggattcacctttaacaactactggatgtcctgggtccgccaggctccagggaggggctggaatgggtggccaacatgaagccagatggaagtcagacatactagtgtggactctgtgaagggccgattcaccatctccaagagacagcgccaatcactcactgtatctgcaaatgaacagcctgagagccgaagacncggctgtttatactgtggcgagaggagggctacgttttgggagttgggttatcgtacccgtttttaggacttacggtgggggaccctaacggggtaaccccgttggtccgttccccgttacgtcccgttcgtcgtccctttccccgaaccgtaacgggccctacgttcccgttacccttcccccgtcggcccgtccccttgcccttcccgaaggaccgtcccgtacccgttaccggaccgaacggcctaccgaacggtcccccggcccgttacgggccgttcgacccgttacgggtacccgaaacgggtaaccccttacgttaccccggtaacgaacccgtacggtacccggttaccgttacgggaccgggtccggggccgttaacgggg

SEQ ID NO: 280693 - DNA, 587 bp, Homo sapiens
  misc_feature: GYAE6OF02G92AD.36.14.B03.1.454.CMB.1.raw
tcagtacgctgtctcacgaccggtgctcgatttagtgtgagtagtttgagtcgtgggggaggcttggtccagccgggggggtccctgagactctcctgtgtagcctctggattcacctttaacaactactggatgtcctgggtccgccaggctccagggagggctggaatgggtggccaacatgaagccagatggaagtcagacatactatgtggactctgtgaagggccattcaccatctccagagacagcgccaatcactcactgtatctgcaaatgaacagtcctgagagccgaagacacggctgtttatactgtgcgagagagggctacgttttggagtggttatcgtcccttttgacttacgtggggccacggggaaccctgggtcctccgtctcctctcgccttccaccgacggcccactcccgtccttccccgtcgccgccctcgcctcccgaggcgccgaccctccggacgacgccaccgccgcccgtcccgtcgggtcctcgcccgtggtaccgaacggtacctaccgttcccgaacgtaaccgacggtaccgtacgtcggacggtcgggcgtacggg

SEQ ID NO: 280694 - DNA, 545 bp, Homo sapiens
  misc_feature: GYAE6OF02GBF36.36.14.B03.1.454.CMB.1.raw
tcagtacgctgtctcacgaccggtgctcgatttagtgtgagtagtttgagtctgggggaggcttggtccagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatatattgtgcgaaacttccttttgactggttatatcccctagtgacactgggccaggaccctggtcaccgtctcctcagcctccacaacggccccatccggtccttcccctcggccacccctcctccaacgacgccacctccgtcggggacacgagacggcccgtgggctcgcctggtcaagacctacttccagacgagcgtacgtgcgcggtcgtggcgacggcgacgatacg

SEQ ID NO: 280695 - DNA, 644 bp, Homo sapiens
  misc_feature: GYAE6OF02J1HN0.36.14.B03.1.454.CMB.1.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (538)..(538): a, c, t, g, unknown or other
  misc_feature (538)..(538): n is a, c, g, or t
tcagtacgctgtctcacgaccggtgctcgatttagtgtgagtagtttgagtctgggggaggcttggtccagccgggggggtcccgtgagactctcctgtgtagcctctggattcacctttaacaactactggatgtcctgggtccgccaggctccagggaagggctggaatgggtggccaacatgaagccagatggagtcagacatactatgtggactctgtgaagggccattcgaccatctccagagacagcgccaatcactcatgtatctnanaaactgaaacncggtcctggaagacggtaccgaaagtaccacgggctttacgttttaataccgtgcgtacggaagagggtacgggacttaccgttttggaggttggttattcggacccttttgaccgtagtcgggggcaaacggggtaccttggtcctccgtccgtcttcgcgtccttcccgacgtaaccggcctactccgttccctccccgtggcccgtccctacgcctcccgtaggccgtaccgtaccgtaccgacggacnccgacgaccgtcccgccgtcgggtctcgtaccgtggtaccggaaaggtacccttacgttcccgaagtaccacggtaccgtacggtacgcggtaccggtcgtaacgg

SEQ ID NO: 280696 - DNA, 641 bp, Homo sapiens
  misc_feature: GYAE6OF02FT34C.36.14.B03.1.454.CMB.1.raw
tcagtacgctgtctcacgaccggtgctcgatttagtgtgagtagtttgagtctggggggaggcttggtccagccggggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccattcaccatctccagagacagccgccaatccactctactttatctgacaaatgaacagcctaggagagccgaagacgaccggctagtttattactgtgcgagaggagggctacgtttggagttggttatcgtcctttgactacggtcggggaccgagggaaccctggtccttcccgtcctcctctcgtccttcccacccgaacgggtcccacgttcccgttcccgttcccccgtcgggtcccgtcccctcgtcccttcccgacggtacgccacccgtccgagcgaccacgaccggcccgcccgtccgggtccgtccgccggttacggtaccggtacggtaccttaaccgtacccaacggaccgtacggaccgttacgtacggacgggtccgggcggtcgggaaccggg

SEQ ID NO: 280697 - DNA, 610 bp, Homo sapiens
  misc_feature: GYAE6OF02FHKTJ.36.14.B03.1.454.CMB.1.raw
  modified_base (290)..(290): a, c, t, g, unknown or other
  misc_feature (290)..(290): n is a, c, g, or t
  modified_base (380)..(380): a, c, t, g, unknown or other
  misc_feature (380)..(380): n is a, c, g, or t
  modified_base (475)..(475): a, c, t, g, unknown or other
  misc_feature (475)..(475): n is a, c, g, or t
tcagtacgctgtctcacgaccggtgctcgatttagtgtgagtagtttgagtctgggggaggcgttggtccagccgggggggtccctgagactctcctgtgtagcctctggattcacctttaacaactactggatgtcctgggtccgccaggctccagggaaggggctggaatgggtgccaacatgaagccagatggaatcagacatactatgtggactctgtgaaggggccattccacctatcctccagagacagcgccaaatccactcactgtatctgcaaatcgaacngcctgagagacgaagacacggtctgttttaattactgtgacgtagagagggactacgttttggagttggtatgtaccctttgacttacgnggggccacgggtaaccctggtcctccgtctcctctctcttccaccgtacggccctacgtcccgtcctccccgtggccgccctcgcctcgcggacnccgtaccctcgacgtacgtaccgaacaccgtccgtcccgtcgggcctcggtaccgtggtacccggtaacggtaccttacccgtacccgtacgtaccgtacggtccggttaacgtcggacggccgggacgtacggg

SEQ ID NO: 280698 - DNA, 588 bp, Homo sapiens
  misc_feature: GYAE6OF02G1S0E.36.14.B03.1.454.CMB.1.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
tcagtacgctgtctcacgaccggtgctcgatttagtgtgagtagttcggttgggacgagagttcactctcacaatcaccagtcctgcaggctgaagatgtggcattttattactgtcagcagtatttgactagtcccgtgtacactatttggccaggggacctaaagctggagctcaaacgactgtggctgcaccatcgtgtcttacgattccttcccggcctagtcgtacgtaacgacagtcgtactcggacgtccggggtcttggacgaaggtcaccgtaagtaacggntcngacngntacgntacgtntatgngntgacgtntagtctagcgtagtcgcgtctcgngtcgtagactagagtancgtacgtgcgacgacgtacgtacgacgtacgtacgtacgacgtactacgtacgcgcgtacgtagtacgtactacgtacgttaacgtacgtacgatacgtacgactacgtacgacgtacgacgacgtacgtacgtacgtacgtaacgtacgtacgtagtacgtacgtaacgtagtaacgtacggtacgacgtacgtaccgtaccgtacgtcgtacgacgtacg

SEQ ID NO: 280699 - DNA, 717 bp, Homo sapiens
  misc_feature: GYAE6OF02GQUVJ.36.14.B03.1.454.CMB.1.raw
  modified_base (189)..(189): a, c, t, g, unknown or other
  misc_feature (189)..(189): n is a, c, g, or t
  modified_base (266)..(266): a, c, t, g, unknown or other
  misc_feature (266)..(266): n is a, c, g, or t
  modified_base (356)..(356): a, c, t, g, unknown or other
  misc_feature (356)..(356): n is a, c, g, or t
tcagtacgctgtctcacgaccggtgctcgatttagtgtgagtagtttgagtcgtggggggaggcttggtccaggccggggggggtccctgagactctcctgtgtagcctctggattcacctttaacaactactggatgtcctgggtccgccaggctccgaggggaaggggctggaagtgggtggccaanatgaagccagatggaatcagacatactatggtggactctgtaggaagggcctattccaccatcctaccaagagaacngaccgtaccaatccactccaacgttgtattctagacaaatgaacagcctgacgaggaccgaaagaccgacggtcttagtttactacgtgnggacgaggagacgggcttacgtttggagttggttactcggttccctttaggacgttacggtcggggacccgtaacggggtacccgtggttaccgtccgttctcctacgtcgtcctaccccgaacgtaaccgggtccctaccgttccccgttcccgttccccgtcggtccccgtaccccgttcggtacccgttaccggaaccgggtccacccgtacccgtacccggaacggtaccgaccctaccgacccgcccggtacccgtggggccctccggtcccgtacggtaaccgtaacggtacccttacctacccggaagtccgaaccggttccgtacggtaccggacgggcccgggcgtaccggg

SEQ ID NO: 280700 - DNA, 810 bp, Homo sapiens
  misc_feature: GYAE6OF02GY7C5.36.14.B03.1.454.CMB.1.raw
tcagtacgctgtctcacgaccggtgctcgatttagtgtgagtagtttgagtcgtgggggaggcttggtccaggccgggggggtccctgagactctcctgtgtagcctctggattcctacctttaacaactactggatgtcctgggtccgccaggctaccgaggggaaggggctaggaagtggggtcggaccaacatggaacgccagagtaggaagtcaggactatactatggtggactcgtgtaggaagggccgtaattccgaacctagtaccgtaccaaggacgaaccgagccgtaccaaatccaacctacactagtactacgtacgaactaaaagtacgaaacgacgtaccgtaggaacggaacggaacccggaaaacgaccgtaaccggttcgttttaagtttaacttttaccgaggttacgacggaaggtaacggtaaagggtcggtacggggttacgtttacgaacgtacgggtcgggggaaccgaacggggtacctcggtaccctaccgtacctccgtaccgaccgtacccgtaacccaaccggaaccggtacccgtaacggttcccggtacccttcccccggtacggtcccgtaccccgttccgtacccgtaccggaacggtaccgaaccctacccgaacccggacgtaccgacgaaccgtaccgggccggtaccccggtacgggtaccgtaccgtacgggtacgtaaaccgaaccggttaacttacccgttaccgaacggaacctacggtacccgtaaggacggtaacgggccggacgtacggaccgtacggaccgtagacg

SEQ ID NO: 280701 - DNA, 604 bp, Homo sapiens
  misc_feature: GYAE6OF02F4SY1.36.14.B03.1.454.CMB.1.raw
  modified_base (257)..(257): a, c, t, g, unknown or other
  misc_feature (257)..(257): n is a, c, g, or t
  modified_base (487)..(487): a, c, t, g, unknown or other
  misc_feature (487)..(487): n is a, c, g, or t
  modified_base (595)..(595): a, c, t, g, unknown or other
  misc_feature (595)..(595): n is a, c, g, or t
tcagtacgctgtctcacgaccggtgctcgatttagtgtgagtagtttgagtctgggggaggcttggtccagccgggggggtccctgagactctcctgtgtagcctctggattcacctttaacaactactggatgtcctgggtccgccaggctccagggaaggggctggaatgggtggccaacatgaagccagatggaagtcagacatacatgtggactctggtgaagggccgaattcaccatctccagagacaggcnccaatcactcactgtatactgcaaaatgaaacacggcctgagaggacccgaagaccgacggctgttttaacttactgtgcgagaggaggactgttttggagttgttatcgtcctttgacgtacgtggggcctagggacccttggtcctccgtctccctcgtcgcgttaccaccgacggcccacgttcccgtcccgttccccgtggcccgccctcgccctaccgaggaccncaccgtaccggacgacgacaccgcccgcccgtcggcgtcgcgtccgtcggtaaccgtaacgtaccttacctacgacgacgtacggtacgtaccggacggccggtcggnggtaacccg

SEQ ID NO: 280702 - DNA, 499 bp, Homo sapiens
  misc_feature: GYAE6OF01C0T3D.10.3.A03.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttgccgggccagtcagacgtttaatattggttggcctggtatcagaagaaaccagggaaagccccgaaactcctgatccatactgcctcactttggcaagtgggtcccatcaaggttcagcggcagtggagctgggacagagttcactctcagtatcagcagcctgcagcctgatgtatttgactaacttattatgtacaactaatatgactacttactccatttctctttcggccctagggaaccaagtgacttaccaaacgtactgtgctgacacctatcgtgtcttctactccttcccgctatctnaacnctacta

SEQ ID NO: 280703 - DNA, 493 bp, Homo sapiens
  misc_feature: GYAE6OF01BL9SZ.10.3.A03.1.454.CMB.1.raw
  modified_base (485)..(485): a, c, t, g, unknown or other
  misc_feature (485)..(485): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccaggggaaagccccgaaactcctgatccatactgcctcacttggcaagtggggtccatcaaggttcagcggcagtggagctgggacagagttcactctcagtatcagcagcctgcagcctgatgattttgctaacctattattgtacaacaatatagactacttatcctattctctttcgcctcggacaagtggataccaaacgactgtggctgcaccatctgttcttctctccttcccgcctactctagacnctactacg

SEQ ID NO: 280704 - DNA, 482 bp, Homo sapiens
  misc_feature: GYAE6OF01BR56M.10.3.A03.1.454.CMB.1.raw
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtgggtcccatcaaggttcagcggcagtggagctgggacagagttcactctcagtatcagcagcctgcagcctgatgatttgcaacctattattgtcaacaatatgacacttatcctattctctttcgcctggaccaagtgattaccaaacgaactgtgctgcaccatctgtcttcnctcttcccgctatctagacnctcta

SEQ ID NO: 280705 - DNA, 541 bp, Homo sapiens
  misc_feature: GYAE6OF01EDDMW.10.3.A03.1.454.CMB.1.raw
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (513)..(513): a, c, t, g, unknown or other
  misc_feature (513)..(513): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaacgccccgaaactcctgatccatactgcctcacttggcaagtgggtccatcaaggttcagcggcaggtggagcgtgggacagagttccactctcagtatcagcagcctgcagcctgtatgtatttcgactaaccttattattgtacaaacaatatanactacttacncctattcctcgtttcggcccgtagggaaccaaaggttcgaacttaccgaaacgtactggtacgctcgcctaccattaccttgttccttactacttcccgtttacccnccttacttcctagaccctacttacctag

SEQ ID NO: 280706 - DNA, 500 bp, Homo sapiens
  misc_feature: GYAE6OF01A67QW.10.3.A03.1.454.CMB.1.raw
  modified_base (240)..(240): a, c, t, g, unknown or other
  misc_feature (240)..(240): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggctggtatcagaagaaaccagggaaanccccgaaactcctgatccatactgcctccactttggcaagtggggtcccatcaaggttcagcggcagtgagctgggacagagttcactctcagtatcagcagcctgcagcctgatgtatttgactaactattattgtacaataatatgactacttatcctattctctttcgcctaggaaccaagtcgacttaccaacgtaactgtgctgcaccatcgtgttcttcacttccttccccgactactctagacctaatctacg

SEQ ID NO: 280707 - DNA, 616 bp, Homo sapiens
  misc_feature: GYAE6OF01BYR7Z.10.3.A03.1.454.CMB.1.raw
  modified_base (232)..(232): a, c, t, g, unknown or other
  misc_feature (232)..(232): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtggggacagagtcatcatcacttgccggccagtcagacgtttaatatggtgctggatcagagaaccagggaacncccgaaactcctgatcatactgcctcactttgcaagtgggtcccatcaaggttcagcgcagtggagctgggacagagttcacgtctcagtatcagcagcctgcagcctagatggtatttcgactaacgttattattgtacaaactaagttactggtaacctaactttatacccctatttaccttccgtttacggacccctaaggggtaacccctaaaggttcggtaaacctttacccgaaaacgtaaaccgttggtacggtaccttacggtacctaaccctaagttcccgttcgttacccgtttacctaaccgtttccccgtttacccccggttaccctaacggtttcccttaaggtaaccccttaaccgttaccttaaaccgg

SEQ ID NO: 280708 - DNA, 640 bp, Homo sapiens
  misc_feature: GYAE6OF01DC3WV.10.3.A03.1.454.CMB.1.raw
tcagcatagtagtgcacgaccggtgctcgatttagagagcgtcacagcatggacatgagggtccccgctcagctcctgggactcctgctgccctggctcccaggtgccaaatgtgacatccagatggcccagtctccttccaccctgtctgcttctggtgggggacagagtcatcatcacttgccggccagtcagtacgtttaataagttggttggccttggtatcgaagaagaaaccgaggggaaacgcccccgaaaatcctagactccaattacctgccctcctactttggacaaggtcggggtacccagtcgtaaggttcaggcggacaggtggagcgtagggacagtacgttcactctcgagtatcgagcacgcctgcagcctgattgtatttcgactaacttattattagtactaaactaatatacgtaactaacttactacctaatttccgttaccgtttccggacccgttacgggtaacctaaaggtacggttaaccttaacccgtaaacgtaaccgttggtacgtacctagaccctaacctactttcgtacgttcctttacgtacctttccccgttacccccgtacctaacttaccgttaccgtaaaccctaccgttaaccttagtaccggg

SEQ ID NO: 280709 - DNA, 612 bp, Homo sapiens
  misc_feature: GYAE6OF01CDOTX.10.3.A03.1.454.CMB.1.raw
  modified_base (247)..(247): a, c, t, g, unknown or other
  misc_feature (247)..(247): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttcgtggtgggggacaggagtcatcatcacttggccgggcagtcagtacgtttaatattggttggcctggtatcaagaagaaaccgagggaaacnccccgaaactcctagactccatactcgcctccactttggcaagtcggggtcccatcgaaggttcagcggcaggtgagctgggacaggtacgttcactctcgagtatcgagcgagtcctgcagcctgacttgtattttgacttagtttacttacgtcgtacgtagtcgtaagttaataagtacgtcgtcggtacccgcggtacgttccgggaccgtaaacggggaccggtagggtaggaacgtttacgaaaacggttaactcgggtacgtacgtcgactaccctaagttccgtggtttcccttacgtacgttccccgtttcccggaccctacgttaccgacgtaaccctaaccgttagtaacccgg

SEQ ID NO: 280710 - DNA, 743 bp, Homo sapiens
  misc_feature: GYAE6OF01BUC80.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggcagtcagtacgtttaatagttggttgcctggtatcagaagaaaccagggaaacgccccgaaactcctagactccatactcgcctcctacgtttggactaaggtcggggtcccagtacgaaggttcgaggcggacgaggtcgggacgtcgtggggaactaggtacggttccaacttccgtacgaagtactacgacgccaacggtccctaggccgaacggtcccttaggtacttaggttaactttttacggacccttaaaccctttaatttacgtttacgtaacctaaaactaaattaacgtacgtaaccttacctttaacttacccttagttttcccgtttccggttttacccggaccccggttaacggggtaaacccttaaaggggttacggttaaacccgtttaacccgtaaaaccggttaacgttcgggtacggtaccgttacggaccctaaccgtaacgtttccgttacgtttacccgtttacctaccgtttaccccgttaccccggaccttacgtttacccgttaaggtaacccttacttaaaccgttacgg

SEQ ID NO: 280711 - DNA, 597 bp, Homo sapiens
  misc_feature: GYAE6OF01ASSEQ.10.3.A03.1.454.CMB.1.raw
  modified_base (552)..(552): a, c, t, g, unknown or other
  misc_feature (552)..(552): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttgccgggccagtcagtacgtttaataagttggttggcctggtatcagaagaaaccgaggggaaacgccccgaaactcctgactccatactcgcctcctacgtttggactaaggtcggggtcccagtacgaaggttcaggcggcaggtggacgcgtgggacaggtagttcactctacagtatcgacgcagcctgcagtcctgattgtacttttacgactaacttatttattcgtacaaactaatactagtaactactttactaccctatttccttccgttttcccggacccgttacgggtaacctaaaggttacggtaacttaaccgaaacgtactggtacgctcgactacctattccgtcgttcctttacnccttcccgttccccgtactacgttctacgtactaccttacgtacg

SEQ ID NO: 280712 - DNA, 555 bp, Homo sapiens
  misc_feature: GYAE6OF01DQ9GK.10.3.A03.1.454.CMB.1.raw
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (519)..(519): a, c, t, g, unknown or other
  misc_feature (519)..(519): n is a, c, g, or t
  modified_base (532)..(532): a, c, t, g, unknown or other
  misc_feature (532)..(532): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttgccgggccagtcagtacgtttaataattggtggcctggtatcagaagaaaccgaggggaaacnccccgaaactcctagactccatactgcctccactttggactaaggtcggggacccatcgaaggttcaggcggcaggtggagcgtgggacagcgttcactctnagtatcgagcagcctgcacgctgatgtactttcgacctaacttattatgtactaataatatacgtactactttactcctatttccttcgtttccggaccgtacgggaacctaaggttcgtaacttaccgaaacgtacgtgtcgacgtcgacgtacctatcttcgtacttacncttcccgttcccnctactcctagacctcgttatacg

SEQ ID NO: 280713 - DNA, 494 bp, Homo sapiens
  misc_feature: GYAE6OF01AZV2H.10.3.A03.1.454.CMB.1.raw
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaatcctgatccatactgcctccactttggcaagtggggtcccatcaaggttcagcggcagtggagctgggacagagttcactctcagtatcagcagcctgcagcctgatgtattttgactaaccttattattgtacaaacaatatagactacttatcctattctctttcgccctgggacctaagtgattaccaaagtactgtgctgcacatctgtcttcnctcctcccgctactctagactctntac

SEQ ID NO: 280714 - DNA, 493 bp, Homo sapiens
  misc_feature: GYAE6OF01BVYO2.10.3.A03.1.454.CMB.1.raw
  modified_base (243)..(243): a, c, t, g, unknown or other
  misc_feature (243)..(243): n is a, c, g, or t
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccaggggaaacnccccgaaactcctgatccatactgcctccactttggcaagtggggtcccatcaaggttcagcggcagtggagctgggacagagttcactctcagtatcagtcagcctgcagcctgatgattttgctaaccttattatgtacaaacatatagacacttancctattctctttcgcctaggaccaagtgattaccaagtactgngctgcaccntcgtctcttcatccgttcccnctacttcngactctatac

SEQ ID NO: 280715 - DNA, 596 bp, Homo sapiens
  misc_feature: GYAE6OF01BXVJI.10.3.A03.1.454.CMB.1.raw
  modified_base (534)..(534): a, c, t, g, unknown or other
  misc_feature (534)..(534): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttgccgggccagtcagtacgtttaataattggttggcctggtatcagaagaaaccgagggaaacgccccgaaatcctgatccatactcgcctctactttggactaaggtcggggtaccccataccgtaaggttcacggcggacagggtcgggagtcgtaggggaacagtacgttccacttctacgagtactcgagcgagccctagcctagcctgtatgtatttgactaacttattattgtacaaactataatacgtaacctaacttactacctatttccttccgtttccggtacccgtaggaacccgtaagtcggtaaccttaaccgaaacgtacgtggtcgctcgactacctnttcgtcgttcttactcttcccgttacccgacctactacctacgtacctaccttaccgttacg

SEQ ID NO: 280716 - DNA, 652 bp, Homo sapiens
  misc_feature: GYAE6OF01BSOW3.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtggggacagagtcatcatcacttcggccgggccagtcagtacgtttaataattggttgcctggtatcaagaacgaaaccgaagggaaacgccccgaaactcctagactaccatactcgcctacctactttggactaaggtcgggtaccagtcgtaaggtcaggcggactaggtggagtcgtacgggacaggtacgttccactctacgagtactcgacgcacgtcctagccgagtcctagtattacgttacttttacgaccttaacctttattacttacgtacctaaataatacgtacgtaaccttactttaactacctactttccttacccggtttaccggcccgttaagggtaaccctaaagggttcgtaaaccttaacccgaaacgtacgttcggtacggtctacgtaccaccgttattccgtccgtttcttacctccgtttacccccgttccccgtaccttacgttactacccgaacttaccttacgtacg

SEQ ID NO: 280717 - DNA, 725 bp, Homo sapiens
  misc_feature: GYAE6OF01DZIXS.10.3.A03.1.454.CMB.1.raw
  modified_base (406)..(406): a, c, t, g, unknown or other
  misc_feature (406)..(406): n is a, c, g, or t
  modified_base (661)..(661): a, c, t, g, unknown or other
  misc_feature (661)..(661): n is a, c, g, or t
tcagcatagtagtgcacgaccggtgctcgatttagagagcgtcacagcatggacatgagggtccccgctcagctcctgggacctcctgctgctctggcctcccaggtgccaaatgtgacatccagatcggcccagttctcccttccaccctgtctgtcttcgtggtagggggacagagtcatcatccacgttcggccgggccagtcagtaacgtttaatagttggtgccttggtatcagaaacgaaaccgagggaaacgaccccgaactcctagactaccattaccgtcgtccctacctacgttggacgtaaggttccgggtacccagtacgtaaggttcaggcggacgaggtcggagtcggtacgggaactacggtacgttacaccgttcgtactacggttaacncgacgtacgaccgtccgtcggaccgtacgtacccgtaggtaacgtttagtttaacgttttaccgaaaccctttaaacctttaagttttaacgtttaccgtaaactaaaacgttaacgttaacgttaaccgtaaccgtttaccttttaacttcccgtttaactttcccgtttaccgtttcccggtacccgtaacgggtaaaccgtaggtacgtaacccgttacaaacggtagttcgtacggcgtacgctacccgtnttccgtacgttccttactcctttacccggtacccctatacctcttacgaacccttcgttgtacg

SEQ ID NO: 280718 - DNA, 589 bp, Homo sapiens
  misc_feature: GYAE6OF01D4FBM.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttcccaccctgtctgcttctggtgggggacagagtcatcatcacttgccgggccagtcagtacgtttaataagttggttggcctggtatcaagaaagaaaccagggaaacgccccgaaactcctgatccatactgcctccactttgacaagtcggggtccatcaaggttcagcggacaggtggagcgtgggacagagttcactctcatatcagcagcctgacagcctagattagtatttcgactaaccttattacttagtaacaactaatatacgaactacttaactcctatttccgttcttttccgggccccttacggggaaccctaaaaggttgggaattaagttaccgaaagtaccggtaaactcgggttaggctacgggacctaaacccgtatttccttaggtttccttacctattcccgttcccgacctactccgtacgacctaacc

SEQ ID NO: 280719 - DNA, 729 bp, Homo sapiens
  misc_feature: GYAE6OF01BL695.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttcgtggtggggacagagtcatcatcacttcggccggcagtcagtacgtttaataagttggttgcctggtatcgaagaacgaaaccgagggaaacgccccgaaactcctagactccatacctcgcctcctacgtttggactaaggtcgggtcccagtctaaggttcaggcgctaggtggagcgtagggacgagtacgttcctactctacgagtactacgagactacgtcctacggaccgtacgtccttaggtatttacgttacgtttttacgaccttaaaccgtttatttacgtttacgttaccgaaaacttaagttaactacgtaaccttaactttaccgttaccttacttttcccgttccgttttacccgggaccccgtttaacggggtaaacccttaaagggttacgtaaaccgttaacccgtaaaaccggttacgttacgggtcggtacgtaccggtacctaaacccttacgttaccgtttcggtttacccttaccgttaccgtttacccccgttacccccggtaccttaccgtttacccgtaaccgtaaccttaacccgtttacgttaccgg

SEQ ID NO: 280720 - DNA, 733 bp, Homo sapiens
  misc_feature: GYAE6OF01C9UYY.10.3.A03.1.454.CMB.1.raw
  modified_base (443)..(443): a, c, t, g, unknown or other
  misc_feature (443)..(443): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatcggcccagtccttcccttcccacccttgtctgtctttcgtgggtgggggacagagtcatcatctacgttcggcccgggcagtacagtaacgtttaaatagttgggtcggtcctaggtatacgaaaggaaacgaaaaccggaggggaaaacccgaccccgtaaaactccgtagaacctacctaattacctcgacccttaccgtagtttacggacgtaacgggtccgggtaccccagttaccggtaaggttccgaaggccggacgtaagggtgggaacggtccggtaggggaactaggtacttcactcgtacaagttacncgagtccgacggcctgaccgtacgtcgttacggtaattgtttacgtttacgaaccttaaactttatttaacgttacgaaaccgtaaaactaagttactaacgttaaccttaacctttaccttactttactttcctttcccgttaccgggtaccccgtaagggtaaaccgtaaggttaccgtaacttaacccgtaaacgtccgttggacgtcctacgccctaacctacgttctaccgttacttcccgtacttccccgtaccgactacttacctagtacctcgttaacgtcg

SEQ ID NO: 280721 - DNA, 708 bp, Homo sapiens
  misc_feature: GYAE6OF01BLCR3.10.3.A03.1.454.CMB.1.raw
tcagcatagtagtgcacgaccggtgctcgatttagagagcgtcacagcatggacatgagggtccccgctcagctcctgggactcctgctgctctggctcccaggtgaccaaatgtgacatccagatcggcccagtcctccttcccaccctgtctgtcttcgtggtggggacagagtcatcatcacgttcggccggcagtcagtacgtttaatagttggtgcctggtatcgaagaagaaaccgagggaaaccacccgaactcgtagactccactactcgcctactacgttcggactacgggtcggtaccagttacggtaaggttcgacggcggtacgtaggtcggacgcggtagggacctaggtcgttaccacttcgtacgtaagtctcgacgcgacgtccacggactacggtcttaggtacttacggttacgtttacgaaccttaacgtttatttacgtacgtaacctaaagttaacttacgttactaacgttaccctttaaactccgtttaactttcccggtttccggttacccggaccgttaacgggtaaacccttaacgggttcgttaaacccctaaccggtaaacgggtacttcgggtacgtaccgtacgtacctaaaccgttcttaccgttccgttacgttaccacccgtttcccctcccgaaacttcccgttaacttaccgaaccgttacgttgttaaccgg

SEQ ID NO: 280722 - DNA, 625 bp, Homo sapiens
  misc_feature: GYAE6OF01BLBLB.10.3.A03.1.454.CMB.1.raw
  modified_base (613)..(613): a, c, t, g, unknown or other
  misc_feature (613)..(613): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttcgtggtggggacagagtcatcatcacttcgccggccagtcagtactttaatagttggtgcctggtatcgaagaagaaaccgagggaaacgccccgaaactcctgactaccatactcgccctcctagtttcggctaaggtcggggtaccccagtaccgtaaggttcagtcggcaggtggagcgtagggacagtacgttccactctagagtactcgagcgacgtcctgacctacggtcctaggtagttgttacgtttcgaaccttaacctttatttaagttcgtaaacctaaacgtaattagtaccgtaacttacttaaccgtccttacgtttccttacggtttcccggaccggtaacggaaccgtaaggttcgtaacctaaccgaacgttcgtgtcgtactcgaccctacctattaccgttcttactacctccttccccgttaccgccttactctaaccncctactcgtacg

SEQ ID NO: 280723 - DNA, 696 bp, Homo sapiens
  misc_feature: GYAE6OF01CRV9H.10.3.A03.1.454.CMB.1.raw
  modified_base (243)..(243): a, c, t, g, unknown or other
  misc_feature (243)..(243): n is a, c, g, or t
tcagcatagtagtgcacgaccggtgctcgatttagagagcgtcacagcatggacatgagggtccccgctcagctcctgggactcctgctgctctggctcccaggtgaccaaatgtgacatccagatcggcccagtctccttccacctgtctgtcttcgtagggtgggggacaggagtacatcatcacgttgctgggccagtcagtactttatagttggtgctggtatcagaagacgaggaacncccgaatctagatccatcacgcctctacgttggactaggtcggtccatacgaacggtcaggcggaccaggtcgggagtccgtagggacgaagttcgttacctacttccgtacgagttacacgaggtaccagtacccgtgactacgtccgtaggtacttacgggttactttaccggacttaaaccgttttgttaacttaggttaaccaaattaacgtattacgtaacctttaacgttaccttaccttcttttacccgtttaccggtacccggttccgttaacggggaaccttaaagggtttaaccggtaccttaaaccggtaaacggttacgtcgggttaaccgccgttaaccggacccttaaccgttgttaccgttaccgtttaccgtttccgtaccctttccccgtaaccccgtctaaccgttcctaaaccggttaccttaacccgttaacg

SEQ ID NO: 280724 - DNA, 690 bp, Homo sapiens
  misc_feature: GYAE6OF01CDUD4.10.3.A03.1.454.CMB.1.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatcggcccagtcctcccttccaccctgtctgtcttcgtggtcgggggacagagttcatcatcacttcggaccggcagtcagtacgtttaatagttggtcgcttggtatacgagaacgaaaccgagggaaaccncccgtaaactcgtagactaccatacctcnccctctacgtttcggacgtaaggtccgggtccctagtacgttacggtcaacggcggtgaggtggacggtacggtagggactaggtacgttacccacgtcttacgaagttactcgacgtacgtacggaccctcggtacgacgtccgtaggtattacggtttactttacggacctttaaccgttagtttaaacgttcgtaaactaaacgtaacttaacgtacgtaaccttaacgtttacctactttacctttaccgttcccgtttacgggacccctaaggtaacccgttaaggttccgaaacgttaaccgaacggttactaggtccgtacttaccgccgtaacctgttacccttgttccctaacgttcccaccgttaccgtctacgtacgtactacctcgtaactcg

SEQ ID NO: 280725 - DNA, 956 bp, Homo sapiens
  misc_feature: GYAE6OF01DJEPL.10.3.A03.1.454.CMB.1.raw
tcagcatagtagtgcacgaccggtgctcgatttagagagcgtcacagcatggacatggacgggtccccgctcagcctccgtgggacctcctgctgctcgtcggcctcccgaggtcgaccaagtgtagactactccgaggacgtccggaccctacgttcccttccccttccctacccgttcggttaccgttcggttccgttttcgggtgggggttacgggggaactaggtacgtactactcaccgttaccgtacgttcggacggttcgggacctacggtacgttaaacgtttaaacgttttaagttacgggtttgggttcggtaccggttaggtacgtaacggaaacggaaaacggaaaccggaaaccggggaaccctaaccccgtaaacttccgtagtaccttaccgaacttccgaccgttacccctacgttacggttacggacgggttaacgggtccggtacctaaggttacgtaacgggttccaaggggccgtacggtaagggtcggtacggacgggtacgggtaactacgttaacgttccgtaacctacgtaacgtaagggtacctacggacgtaaccgggtcgttacccgagtaacccggtggttacctaagggtttttacttacggtttaaccgtttaaccgaacccgttttaacgtttaacgtttacgttaaaccgttaaaacttaacgttaacgttaacgttacttaaaccttttacgttaccctttactttccgtttaccgtttccggtacccggttaacggttaacggtaaacgttaacggttacgttaaccgtaaaaccgtgggtttaaccgttcgggaccttacggtccgtaaaccgtaccgttacggtttccccttaggtttacccttacccgttaccccgttcccgttaaaccccggttacctttactaacccggttaacccggttacctttacggttaccgg

SEQ ID NO: 280726 - DNA, 715 bp, Homo sapiens
  misc_feature: GYAE6OF01D8WSM.10.3.A03.1.454.CMB.1.raw
  modified_base (465)..(465): a, c, t, g, unknown or other
  misc_feature (465)..(465): n is a, c, g, or t
  modified_base (494)..(494): a, c, t, g, unknown or other
  misc_feature (494)..(494): n is a, c, g, or t
  modified_base (661)..(661): a, c, t, g, unknown or other
  misc_feature (661)..(661): n is a, c, g, or t
  modified_base (668)..(668): a, c, t, g, unknown or other
  misc_feature (668)..(668): n is a, c, g, or t
tcagcatagtagtgcacgaccggtgctcgatttagagagcgtcacagcatggacatggagggtccccgctcagcttcctgggactcctgctgctcgtggctcccaggtcacctaaatgtagacactccgagtagtcggaccctagttcccttcccttacccgacccttgttctcgtcgttcgtgggtcggggaacaggatcatcacttcctacgttcggcccggactagtactaagttaacgtttaagttacgtttggtcgctaggtactagaacgaaacgaaaccggaacggaaaccgtaccccgtaaacgtcctagacttacctataaccgtccgtaccttacctacggttgaaccgttacggggtaccggtacccaggttaccgtacggttacgacggtccggacgtaggtagggcgtacggtacgggactaggtacctttacaccttcgtagacgttaacncgtaacgcgaccgtagtcaccgcttacgnttacgttagtttacgtttacgtaacccttacgttaatttacgtataaaccaattaacgttactacgtaacttacgttactaccttacgttccgttcccgttacgtaccgttacgaagttaacgtacgtaactaaccgtaagtctcgacgtctacgtctactacgttnttccttntccttacccgtccttccctacgtacttcaaccttacacccttgtacg

SEQ ID NO: 280727 - DNA, 575 bp, Homo sapiens
  misc_feature: GYAE6OF01ESLES.10.3.A03.1.454.CMB.1.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtggggacagagtcatcatcacttggccggccagtcagtacgtttaaatagttggttgcctgtatcaagaagaaacgagggaaacnccccgaaatcgtanatccatactgcctcatttgcaagtggccatcaaggtnagcggnagtggancgtagggacagngttccactctacagtactcgacgcaggcctgcacgctgacttgtaatttgacttaaccttatttacttacgtacaaactaatactacgaaccttacttactacctacgttccttcgtttcccggaccgtaagggacctaaaggtcgtacctttaaccgaaacgtaacgttcggtacggtctacggcctaaccgtataccgttcgttacctctaacttcccgtacccgaccttacgtactacgtacctactactacg

SEQ ID NO: 280728 - DNA, 476 bp, Homo sapiens
  misc_feature: GYAE6OF02IYO8A.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtgggtcccatcaaggttcagcggcagtggagctgggacagagttcactctcagtatcagcagcctgcagcctgatgatttgctaacctattattgtacaacaatatgacacttatcattctcttcgcctggacaagtgatcaagactgtgctgcacatctgtcttctatcttcccgctactcctgactactatac

SEQ ID NO: 280729 - DNA, 480 bp, Homo sapiens
  misc_feature: GYAE6OF02I58NU.10.3.A03.1.454.CMB.1.raw
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgatttgctaacctattattgtcaacaatatgactacttatcctattctctttcggcctggaccaagtgattcaacgactgtgctgcaccatctgtcttcattctccgcnctctgacactntac

SEQ ID NO: 280730 - DNA, 486 bp, Homo sapiens
  misc_feature: GYAE6OF02G8GG7.10.3.A03.1.454.CMB.1.raw
  modified_base (382)..(382): a, c, t, g, unknown or other
  misc_feature (382)..(382): n is a, c, g, or t
  modified_base (447)..(447): a, c, t, g, unknown or other
  misc_feature (447)..(447): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaacgccccgaaactcctgatccatactgcctccactttggcaagtgggtcccatcaaggttcagcggcagtggagctgggacagagttcactctcagtatcagcagcctgcagcctgatgatttgctaactattattgtacaanaatatgacacttatccattctcttcgcctggaccaagtgattcaacgtactgtgctgcacatctntcttcacttccttcccgctacttctgacctactactacg

SEQ ID NO: 280731 - DNA, 488 bp, Homo sapiens
  misc_feature: GYAE6OF02GUNDE.10.3.A03.1.454.CMB.1.raw
  modified_base (456)..(456): a, c, t, g, unknown or other
  misc_feature (456)..(456): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgctgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgtattttgctaacctattattgtacaactaatatgactacttatcctattctctttcgcctggacctaagtgattccaaacgactgtgctgcacatctntctctactccttcccgctactctcgacactac

SEQ ID NO: 280732 - DNA, 486 bp, Homo sapiens
  misc_feature: GYAE6OF02FNQ6W.10.3.A03.1.454.CMB.1.raw
  modified_base (455)..(455): a, c, t, g, unknown or other
  misc_feature (455)..(455): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctgggaccaaagtgattccaaacgaactgtggctgcacatctntcttcatcttcccgcactcctgacactatac

SEQ ID NO: 280733 - DNA, 510 bp, Homo sapiens
  misc_feature: GYAE6OF02G40XM.10.3.A03.1.454.CMB.1.raw
  modified_base (492)..(492): a, c, t, g, unknown or other
  misc_feature (492)..(492): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaacgccccgaaactcctgatccatactgcctcactttggcaagtgggtcccatcaaggttcagcggcagtggagctgggacagagttcactctcagtatcagcagcctgcagcctgatgtattttgactaaccttattacttgtacaaactaatatagactacttactcctatttcctctttccggcccttgggacctaaagtcgtacttaccaaacgtactggtgctgcacatctgtcttcacttccttcccnctctctgactactactac

SEQ ID NO: 280734 - DNA, 624 bp, Homo sapiens
  misc_feature: GYAE6OF02IHI39.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttgctggtatcagaagaaaccagggaaacgccccgaaactcctagatccatactgcctcacttggcaagtcgggtccatcaagttcagcggcagtggagcgtgggacagagttcactctagagtatcagcagctgcagctgatgtatttgactaactattatgtacaaacaatatgaactacttaatcctatttcctacgttttccggacccgttacgggaacctaaaaggttcggtaaactttaaccccaaaaacggtaaaccgttcggttacgggtaccttacggacctaacccgtaacgtttccgttaacggttttaccctttaaccgtaccttttaccccgtttacccccggtacccgtaacctttcccgttaaccggttaaacccttaaccctttaaccgtttaaccgg

SEQ ID NO: 280735 - DNA, 551 bp, Homo sapiens
  misc_feature: GYAE6OF02JBANW.10.3.A03.1.454.CMB.1.raw
  modified_base (262)..(262): a, c, t, g, unknown or other
  misc_feature (262)..(262): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttgcctggtatcagaagaaaccagggaaagccccgaaatcctgatccatacngcctcactttggcaagtgggtcccatcaaggtcagcggcagtggagctgggacagagttcactctcagtatcaagcagcctgcagcctgatgtattttgactaactatttattcgtactaaactaatactagtaactactttaatcctaatttccttcgtttccggacccgttagggaacctaaacgttggaacttaaccgaaacgtacttcgtacggctcgacctacctagttccgtcgtaccttctaacttcccttacccgactacttcctacgaactactactacg

SEQ ID NO: 280736 - DNA, 679 bp, Homo sapiens
  misc_feature: GYAE6OF02FW8P2.10.3.A03.1.454.CMB.1.raw
  modified_base (204)..(204): a, c, t, g, unknown or other
  misc_feature (204)..(204): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaanattggttggcctggtatcagaagaaaccagggaaacgccccgaaactcctgatccatactcgcctccactttggcaagtgggtcccatcaggttcagcgcagtggagcgtgggacagacgttcactctcagtactcagcagcctagcagcctgattgtattttcgacctaacctttatttaactttgtaacctaaactaaattaactacggaaccttaaccttttaactacccttaaacttttccgttacccgtttttacccgggtcccccgtttaacgggggtaaaccccttaaaacggggttcgggttaaacctttaaaccccggtaaaacgttaaccgtttacggttacggtaccgttaccggacccgtaaccctacgtttaccgtttcggtttcctttaaccgtaccgtttcccgttacccccgtaccttaaccgttcccgttaacggtaacccttaccttaccgttaacg

SEQ ID NO: 280737 - DNA, 551 bp, Homo sapiens
  misc_feature: GYAE6OF02FOQIB.10.3.A03.1.454.CMB.1.raw
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataagttggttggcctggtatcaagaagaaaccagggaaacgccccgaaactcctgatccatactgcctccactttggcaaggtcgggtcccatcaagttcagcggnaggtggagtcgtagggacaggtagttcactctanagtatcgagcacgctgcagcctagatgtattttcgactaaccttatttattagtacaaactaatatacgaactacttatacctattccttctttccggcccgtagggaacctaaaggttcgaacttacccgaaacgtacgtgtcgactcgactacctatctagttcttactccttccttcccgcctacgtcctactactactactacg

SEQ ID NO: 280738 - DNA, 631 bp, Homo sapiens
  misc_feature: GYAE6OF02IT25Q.10.3.A03.1.454.CMB.1.raw
  modified_base (327)..(327): a, c, t, g, unknown or other
  misc_feature (327)..(327): n is a, c, g, or t
  modified_base (380)..(380): a, c, t, g, unknown or other
  misc_feature (380)..(380): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttcgtggtgggggacagagtcatcatcacttgccggccagtcagtacgtttaaatattggttggcctggtaatcaagaaagaaaccgagggaaacgtccccgaaactcctgactccaatactcgaccttaccactttggacaaggtcggggtcccatacgaaggttcaggccggnaggtcggagcgtgggacagtagttcactcgtactagtatcaagcaacgtccgngacgacgtccgtagaactttggttacgtttacgaaccttaaacctttaagttttaactttacgtaaactaaaactaacttaacgtaacgtaacttaactttactaccgttactttccttaccgtttccggtacccgtaacgggaaaccttaagttacgtaacttaaccgaaacgtacgtggtacgctacgaccactacgtctacgttacctctacttccgttaccgacctatacctacgtactactacgtg

SEQ ID NO: 280739 - DNA, 618 bp, Homo sapiens
  misc_feature: GYAE6OF02GBZP3.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttgccgggccagtcagtacgtttaataagttgggttgcctggtatcaagaacgaaaccgagggaaacgaccccgaaactcctagactccatactgcctccactttggcaaggtcggggtacccagtacgtaaggttcaggcggacaggtggagcgtgggacaggtacgttcactctacagtactcagcacgcctgcacgcctgatgtattttgacctaaccttatttattcgtactaaactaatagtacgacctaactttaactcctaatttcctttcgtttccgggtacccgttaggggtaaaccctaaaggtacggttaacttaacccgaaacgtaacgttggtcggtacttcgaccacctattaccgttcgttaccttacctaacctttcccgttaccctacctacttcctaccggaccttacccgttattaacg

SEQ ID NO: 280740 - DNA, 523 bp, Homo sapiens
  misc_feature: GYAE6OF02IWG8U.10.3.A03.1.454.CMB.1.raw
  modified_base (406)..(406): a, c, t, g, unknown or other
  misc_feature (406)..(406): n is a, c, g, or t
  modified_base (476)..(476): a, c, t, g, unknown or other
  misc_feature (476)..(476): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagtacgtttaataattggttggcctggtatcagaagaaaccgagggaaacgccccgaaactcctgactccatactgcctcctacttggacaaggtcggggtcccatcaaggttcagcggcaggtggagcgtgggacagtagttcactctcagtactcagcacgcctagcagcctgatgtatttgactaacctattattgtacaaataatatanactacttactctattctcttccgcctggacctaagtcgtactaccaaacgtacgtgtacgctcgccactntctcgtcttcctacttcccgtcccgctactctacgactactactacg

SEQ ID NO: 280741 - DNA, 570 bp, Homo sapiens
  misc_feature: GYAE6OF02IW87M.10.3.A03.1.454.CMB.1.raw
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtggggacagagtcatcatcacttgccgggcagtcagacgtttaatattggttgcctggtatcagaagaaaccagggaaacgccccgaaatcctgatccaatactgcctccactttggcaaggtgggtcccagtcaaggttcagtcggnagtggagcgtagggacaggacttcgactcgtacaagtatcgagtcacgcctagcagccgtgactgtattttcgactaaccttattagttcgtacaaacaattntaacgacttacttaactaccttattaccttccgtttacgcccgttaggaacctaaaggtcgtattaaccaacgtaagtcggtcggtactagacctacctacttcgtagttaccgttctaacttcccgttacccgcctagttcctccgtaactacgtactacg

SEQ ID NO: 280742 - DNA, 852 bp, Homo sapiens
  misc_feature: GYAE6OF02IB7JT.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatcggcccagtctccttccaccctgtctgcttcgtggtgggggacaggagtcatcatcacttggccgggccagtcagacgttttaataatttggttggctggtatcaagaagaaacgagggaaacgaccccgaaactcctagactaccattactagccctacctaacgtttggacgtaacgggttcggggttacccccaagttaccgtaaacggggtttaccgaacgggtaccgggtaccggaaggggtcggggtaacggtcccgggttaaggggggaacctaacggggttacggtttaacccaccggtttacccgttaccgtaaaggtttaaccgtccgaaacggacccggtaacggtaccccgttacgggtaccctaacggggtccctttagggtaaacggttttcggtttaaacgtttttaccggaaccctttaaaacccgtttaatttttaacgtttaacggttaaacctaaaacgttaaattaacgtaacgtaaaccttaacctttaaacctttacccgttaacttttaccgtttcccgttttacccgggtaccccggtttaacggggtaaaccggttaaacgggttacggtaaccttaaaaccggtaaacgtaaccgttaggtcggtacctacgaccctactacgtttaccgttcgttacttacctaccgtttacccttacccgtacgtacgttaccgttacgtaaccctacgttaacttacg

SEQ ID NO: 280743 - DNA, 669 bp, Homo sapiens
  misc_feature: GYAE6OF02I1USI.10.3.A03.1.454.CMB.1.raw
  modified_base (244)..(244): a, c, t, g, unknown or other
  misc_feature (244)..(244): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttgccgggccagtcagacgtttaataattggtggcctggtatcagaaagaaaccgagggaaacnccccgaaactcctagactccatacctcgcctccatttggctaaggtcgggtccagtacaaggttcacgtcggctaggtggacgcgtagggacaggtacgttcaccttctacgagtactcgagtcacgccgtgccacgcctagagtgttattttcgactaaaccttattagttacgtaacaaactaataactacgaacgtacttaattacccttacttttccgttaccgtttccggaccccggtttacgggtaaacccgttaaacggttacggtaacgtttaaacccgtaaacggtaaccgtttcgggtaccggtacgtaccggactaaccgtaactttcccgttacgtttcccgttacctaacgtttacccgtttaccccggaccttacgttaccgttaccgtaaccgtttaacctaccgttacg

SEQ ID NO: 280744 - DNA, 628 bp, Homo sapiens
  misc_feature: GYAE6OF02IBBW6.10.3.A03.1.454.CMB.1.raw
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagcatagtagtgcacgaccggtgctcgatttagagagcgtcacgagcatggacatgagggtccccgctcagctcctgggactcctgctgctctggctcccaggtgccaaatgtgacatccagatcggcccagtctccttccaccctgtctgcttctggtggggacagagtcatcatcacgttgccgggccagtcagtacgtttaataagttggttggccttggtatcgaagaacgaaaccgagggaaacgaccccgaaatcctagactccatactgcctcactttggacaaggtcgggacccagtcgaaggttcgagcggcaggtggagcgtgggacaggtacgtcactacncaagttacncagacagcctgcagtctagatgtatttgactaacttattatacgtacaaatatatagtactactttactccttaattcctttaccgttccggtacccgttagggaacctaaaggttcgtaaccgttaacccgaaacgttaacgttggtacggaccttacggacctaaccgtacgttccgtacgttacctttacgtaacccgtttacccgttacccgtaccttacgttacccgttaacgtaaccctttaacccgtacgttaaccgg

SEQ ID NO: 280745 - DNA, 621 bp, Homo sapiens
  misc_feature: GYAE6OF02JRZBJ.10.3.A03.1.454.CMB.1.raw
  modified_base (572)..(572): a, c, t, g, unknown or other
  misc_feature (572)..(572): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtcctccttccaccctgtctgcttcgtggtgggggacagagtcatcatcacgttcgccgggccagtcagtacgtttaatagttggtcgcctggtatcgaagaagaaaccgagggaacaccccgaaactcgtagactccatactcgccctacgtacgtttggactaacggttcgggtaccctagtccgtaagggttccaggcggtcgaaggtggacggtcggtagggactaggtacgttacaccgtctacgagtactcgaagcgacgctacgcacgtctgactttgtactttcgactaacctttagttacttagtactaactaagtactacgaaccttacgttactaccttactttcccgttacgttcccggacccgtacggtaaccgtaaggttccgtaacgttaacccgaaacgtacgtcgtacgcgtacgtaccacgtntccgtagttcctctaacttcccgtctacctctactacacctagtactcg

SEQ ID NO: 280746 - DNA, 790 bp, Homo sapiens
  misc_feature: GYAE6OF02HKVWU.10.3.A03.1.454.CMB.1.raw
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttcgtggtgggggacagagtcatcatcacttggccgggccagtcagtacgtttaataattggttggctggtatcagaaagaaaccgagggaacgaccccgaaactcctgactccatactcgcccttcctacgtttcggcgtaacggttccggggtacccctagtacgttaaacgggttcgaacggtccggacgtagggttacgggacggtcggttaggggaacctaggtacggtttaccaccttccgttacgtaaggtacttcgaacgtacgacgtcccgtagacccgtacggtaccctggtaagtttcggttaacgtttttacggaaccctttaaaacccgtttagttttaacgtttaaccggttaacctaaaacgttaaacttagttaaccgtaaaccttacctttaaccgttaccttacgttttacccttccgtttacccgggacccggtttaacgggaaacccgttaaacggttaccggtaaaccgttacccgaaaaaccggttacgttacggtaccggtaccgttacgcccgtaaccgttaccgttcgttaaccgtttccttaacccgttccgtttacccccgttcccggtaccttacccgttcttaaccggtaccttacccgttattaccgg

SEQ ID NO: 280747 - DNA, 650 bp, Homo sapiens
  misc_feature: GYAE6OF02G5SSI.10.3.A03.1.454.CMB.1.raw
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttcgtggtggggacagagtcatcatcacgttcggccgggccagtcagtacgtttaatagttggtgcctggtatcagaacgaaaccagggaaacnccccgaaatccgtagactccatacncgcctcctacttggctaaggtcgggtcccagtccgtaaggttcacgcggactaggcggagcgtagggactaggtacgttcaacgtctacgagttactaccgagcgaacgtccgtgaccgtacgtccgtgacttgtacgtttcgaaccttaacttagttatacggtaactaaactattacgagtacctacgtttactaccgttactttccgttcgttaccggaccgttaacggtaaccgtaagggttcgtaaaccttaaccggtaaacgtccgtttcgggtacgtaccgtacgtacccgtagttccgttacgttcgttacccgtttacaccgtttacccgttcccgacttacgtccgtaactaccttacgttacctacgg

SEQ ID NO: 280748 - DNA, 567 bp, Homo sapiens
  misc_feature: GYAE6OF02FUTUE.10.3.A03.1.454.CMB.1.raw
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagcatagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctggtgggggacagagtcatcatcacttcgccgggccagtcagtacgtttaatagttggttgcctggtatcagaagaaaccgagggaacgccccgaaacgtcctagactccatacctgcctcctatttggctaaggtcgggtcccatcgaggtcagcggcaggtggancgtgggacagtagttcactctacatacncagcagcctgcagcctgatgttatttcactaacttattactagtacaactaatactacgtactacttactccttattccttaccgtttccggtaccgtacgggaacctaaggtcgttaacttaccgaaacgtacgttggtacgacgtcgacctaccgtattccgtcttaccttctacctttccttcccgactacgttcctagaaccttctacgtacg

SEQ ID NO: 280749 - DNA, 651 bp, Homo sapiens
  misc_feature: GYAE6OF02JUHBJ.10.3.A03.1.454.CMB.1.raw
  modified_base (70)..(70): a, c, t, g, unknown or other
  misc_feature (70)..(70): n is a, c, g, or t
  modified_base (133)..(133): a, c, t, g, unknown or other
  misc_feature (133)..(133): n is a, c, g, or t
  modified_base (176)..(176): a, c, t, g, unknown or other
  misc_feature (176)..(176): n is a, c, g, or t
  modified_base (183)..(183): a, c, t, g, unknown or other
  misc_feature (183)..(183): n is a, c, g, or t
  modified_base (626)..(626): a, c, t, g, unknown or other
  misc_feature (626)..(626): n is a, c, g, or t
tcagcatagtagtgcacgaccggtgctcgatttagagagcgtcacagcatggacatgagggtcccgctcngctcctgggactcctgctgctctggctcccaggtgccaaatgtgacattccaggatcggcccngttcctcccttccaccctgtctgtcttcgtggtcggggacagngtcatcntctacgttcggccggcagtcagtacgttaatagttggtgctaggtatcaagaacgaaccgaggaaccgaccccgaactctagctaccatcgtaccgtcctaccttcgttacggcgtaacggtccggggtaccacgtcgtaacggtcgacgggcgacgcggtggacgtcgtacgggactaggtcgttccatccgtgtaacgtctacgtagcgtacgccgtgcctacggaccttggtaaattcgttaacgttttacctaaacgtttacgtttactaacgtaacctaaagtaacgtttacaacgttcttaacttacttacttacttcgttcttcggtacgtcgaacgtagtaccgtataacctaagtacgtgtactcgtccgtacctaggttccttacgttccgttacttcccggttaacttccccgtaccgtctacgttaccgtntaacccgttacttacgtacgttcgg

SEQ ID NO: 280750 - DNA, 168 bp, Homo sapiens
  misc_feature: GYAE6OF01DHCPK.37.53.E09.1.454.CMB.1.raw
  modified_base (168)..(168): a, c, t, g, unknown or other
  misc_feature (168)..(168): n is a, c, g, or t
tcagtagtgtagatcacgaccggtgctcgatttagagagagtgtgttgggttgggaagaggaagactgacggtcccaggagttcaggtgctgggcacagcggccctgggctgcctggtcaaggactacttccatctacactactgagcgggctggcaaggcgcatagn

SEQ ID NO: 280751 - DNA, 177 bp, Homo sapiens
  misc_feature: GYAE6OF01ASHSX.37.53.E09.1.454.CMB.1.raw
  modified_base (170)..(177): a, c, t, g, unknown or other
  misc_feature (170)..(177): n is a, c, g, or t
tcagtagtgtagatcacgaccggtgctcgatttagagagagtgtgttgggttggggaagaggaagactgacggtccccaggagttcaggtgctgggcacagcggccctgggctgcctggtcaaggactacttccatctacactactgagcgggctggcaaggcgcatagnnnnnnnn

SEQ ID NO: 280752 - DNA, 169 bp, Homo sapiens
  misc_feature: GYAE6OF01DPNNG.37.53.E09.1.454.CMB.1.raw
  modified_base (163)..(169): a, c, t, g, unknown or other
  misc_feature (163)..(169): n is a, c, g, or t
tcagtagtgtagatcacgaccggtgctcgatttagagagagtgtgttggttgggaagaggagactgacggtcccaggagttcaggtgctggcacagcggcctggctgcctggtcaaggactacttccatctacactactgagcgggctggcaaggcgcatagnnnnnnn

SEQ ID NO: 280753 - DNA, 168 bp, Homo sapiens
  misc_feature: GYAE6OF01B23L6.37.53.E09.1.454.CMB.1.raw
  modified_base (168)..(168): a, c, t, g, unknown or other
  misc_feature (168)..(168): n is a, c, g, or t
tcagtagtgtagatcacgaccggtgctcgatttagagagagtgtgttgggtttgggaagaggaagactgacggtccccaggagttcaggtgctggcacagcggcctgggctgcctggtcaaggactacttccatctacactactgagcgggctggcaaggcgcatagn

SEQ ID NO: 280754 - DNA, 170 bp, Homo sapiens
  misc_feature: GYAE6OF01AQ0DB.37.53.E09.1.454.CMB.1.raw
  modified_base (170)..(170): a, c, t, g, unknown or other
  misc_feature (170)..(170): n is a, c, g, or t
tcagtagtgtagatcacgaccggtgctcgatttagagagagtgtgttgggtttgggaagaggaagactgacggtccccaggagttcaggtgctgggcacagcggccctgggctgcctggtcaaggactacttccatctacactactgagcgggctggcaaggcgcatagn

SEQ ID NO: 280755 - DNA, 171 bp, Homo sapiens
  misc_feature: GYAE6OF01A0B0F.37.53.E09.1.454.CMB.1.raw
  modified_base (171)..(171): a, c, t, g, unknown or other
  misc_feature (171)..(171): n is a, c, g, or t
tcagtagtgtagatcacgaccggtgctcgatttagagagagtgtgttgggtttggggaagaggaagactgacggtccccaggagttcaggtgctgggcacagcggccctgggctgcctggtcaaggactacttccatctacactactgagcgggctggcaaggcgcatagn

SEQ ID NO: 280756 - DNA, 166 bp, Homo sapiens
  misc_feature: GYAE6OF01CYDWH.37.53.E09.1.454.CMB.1.raw
  modified_base (166)..(166): a, c, t, g, unknown or other
  misc_feature (166)..(166): n is a, c, g, or t
tcagtagtgtagatcacgaccggtgctcgattagagagagtgtgttgggttgggaagaggaagactgacggtcccaggagttcaggtgctggcacagcggccctgggctgcctggtcaaggactacttccatctacactactgagcgggctggcaaggcgcatagn

SEQ ID NO: 280757 - DNA, 203 bp, Homo sapiens
  misc_feature: GYAE6OF01BF7A6.37.53.E09.1.454.CMB.1.raw
  modified_base (169)..(169): a, c, t, g, unknown or other
  misc_feature (169)..(169): n is a, c, g, or t
  modified_base (175)..(203): a, c, t, g, unknown or other
  misc_feature (175)..(203): n is a, c, g, or t
tcagtagtgtagatcacgaccggtgctcgatttagagagagtgtgttgggtttggggaagaggaagacctgacggtccccaggagttcaggtgctgggcacgacgcggccctgggctgccctgggtcaaggctacttccatctacactactgagcgggctggcaaggcncatagnnnnnnnnnnnnnnnnnnnnnnnnnnnnn

SEQ ID NO: 280758 - DNA, 177 bp, Homo sapiens
  misc_feature: GYAE6OF01DVW58.37.53.E09.1.454.CMB.1.raw
  modified_base (173)..(177): a, c, t, g, unknown or other
  misc_feature (173)..(177): n is a, c, g, or t
tcagtagtgtagatcacgaccggtgctcgatttagagagagtgtgttgggtttgggggaagaggtaagactgacggtccccaggagttcaggtgctgggcacagcggccctgggctgcctggtcaaggactacttccatctacactactgagcgggctggcaaggcgcatagnnnnn

SEQ ID NO: 280759 - DNA, 169 bp, Homo sapiens
  misc_feature: GYAE6OF01A7MHK.37.53.E09.1.454.CMB.1.raw
  modified_base (169)..(169): a, c, t, g, unknown or other
  misc_feature (169)..(169): n is a, c, g, or t
tcagtagtgtagatcacgaccggtgctcgatttagagagagtgtgttgggttgggaagaggaagactgacggtccccaggagttcaggtgctgggcacagcggccctgggctgcctggtcaaggactacttccatctacactactgagcgggctggcaaggcgcatagn

SEQ ID NO: 280760 - DNA, 171 bp, Homo sapiens; identical to SEQ ID NO: 280755
  misc_feature: GYAE6OF01DGWU4.37.53.E09.1.454.CMB.1.raw
  modified_base (171)..(171): a, c, t, g, unknown or other
  misc_feature (171)..(171): n is a, c, g, or t

SEQ ID NO: 280761 - DNA, 171 bp, Homo sapiens; identical to SEQ ID NO: 280755
  misc_feature: GYAE6OF01BOAO2.37.53.E09.1.454.CMB.1.raw
  modified_base (171)..(171): a, c, t, g, unknown or other
  misc_feature (171)..(171): n is a, c, g, or t

SEQ ID NO: 280762 - DNA, 171 bp, Homo sapiens; identical to SEQ ID NO: 280755
  misc_feature: GYAE6OF01CTE3S.37.53.E09.1.454.CMB.1.raw
  modified_base (171)..(171): a, c, t, g, unknown or other
  misc_feature (171)..(171): n is a, c, g, or t

SEQ ID NO: 280763 - DNA, 211 bp, Homo sapiens
  misc_feature: GYAE6OF01EO1KX.37.53.E09.1.454.CMB.1.raw
  modified_base (173)..(211): a, c, t, g, unknown or other
  misc_feature (173)..(211): n is a, c, g, or t
tcagtagtgtagatcacgaccggtgctcgatttagagagagtgtgttgggtttgggggaaggaggaagactgacggtcccccaggacgttcaggtgctgggcacagcggcctggctgcctggtcaaggctacttccatctacactactggagcgggctggcaaggcgcatagnnnnnnnnnnnnnnnnnnnnnnnnnnnnnnnnnnnnnnn

SEQ ID NO: 280764 - DNA, 177 bp, Homo sapiens
  misc_feature: GYAE6OF01EM5JO.37.53.E09.1.454.CMB.1.raw
  modified_base (173)..(177): a, c, t, g, unknown or other
  misc_feature (173)..(177): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagnnnnn

SEQ ID NO: 280765 - DNA, 173 bp, Homo sapiens
  misc_feature: GYAE6OF01C09BA.37.53.E09.1.454.CMB.1.raw
  modified_base (173)..(173): a, c, t, g, unknown or other
  misc_feature (173)..(173): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagn

SEQ ID NO: 280766 - DNA, 173 bp, Homo sapiens; identical to SEQ ID NO: 280765
  misc_feature: GYAE6OF01EARRM.37.53.E09.1.454.CMB.1.raw
  modified_base (173)..(173): a, c, t, g, unknown or other
  misc_feature (173)..(173): n is a, c, g, or t

SEQ ID NO: 280767 - DNA, 198 bp, Homo sapiens
  misc_feature: GYAE6OF01EIM5U.37.53.E09.1.454.CMB.1.raw
  modified_base (172)..(198): a, c, t, g, unknown or other
  misc_feature (172)..(198): n is a, c, g, or t
tcagtagtgtagatcacgaccggtgctcgatttagagagagtgtgttgggtttgggggaaggaggaagactgacggtcccccaggagttcaggtgctgggcacagcggcctgggctgcctggtcaaggctacttccatctacactactgagcgggctggcaaggcgcatagnnnnnnnnnnnnnnnnnnnnnnnnnnn

SEQ ID NO: 280768 - DNA, 172 bp, Homo sapiens
  misc_feature: GYAE6OF01DX57J.37.53.E09.1.454.CMB.1.raw
  modified_base (172)..(172): a, c, t, g, unknown or other
  misc_feature (172)..(172): n is a, c, g, or t
tcagtagtgtagatcacgaccggtgctcgatttagagagagtgtgttgggtttgggggaagaggaagactgacggtccccaggagttcaggtgctgggcacagcggccctgggctgcctggtcaaggactacttccatctacactactgagcgggctggcaaggcgcatagn

SEQ ID NO: 280769 - DNA, 173 bp, Homo sapiens; identical to SEQ ID NO: 280765
  misc_feature: GYAE6OF01C7PYD.37.53.E09.1.454.CMB.1.raw
  modified_base (173)..(173): a, c, t, g, unknown or other
  misc_feature (173)..(173): n is a, c, g, or t

SEQ ID NO: 280770 - DNA, 174 bp, Homo sapiens
  misc_feature: GYAE6OF01D4RBK.37.53.E09.1.454.CMB.1.raw
  modified_base (173)..(174): a, c, t, g, unknown or other
  misc_feature (173)..(174): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagnn

SEQ ID NO: 280771 - DNA, 173 bp, Homo sapiens; identical to SEQ ID NO: 280765
  misc_feature: GYAE6OF01CU199.37.53.E09.1.454.CMB.1.raw
  modified_base (173)..(173): a, c, t, g, unknown or other
  misc_feature (173)..(173): n is a, c, g, or t

SEQ ID NO: 280772 - DNA, 173 bp, Homo sapiens; identical to SEQ ID NO: 280765
  misc_feature: GYAE6OF01B9B6K.37.53.E09.1.454.CMB.1.raw
  modified_base (173)..(173): a, c, t, g, unknown or other
  misc_feature (173)..(173): n is a, c, g, or t

SEQ ID NO: 280773 - DNA, 172 bp, Homo sapiens
  misc_feature: GYAE6OF01A28HX.37.53.E09.1.454.CMB.1.raw
  modified_base (171)..(172): a, c, t, g, unknown or other
  misc_feature (171)..(172): n is a, c, g, or t
tcagtagtgtagatcacgaccggtgctcgatttagagagagtgtgttgggtttggggaagaggaagactgacggtccccaggagttcaggtgctgggcacagcggccctgggctgcctggtcaaggactacttccatctacactactgagcgggctggcaaggcgcatagnn

SEQ ID NO: 280774 - DNA, 171 bp, Homo sapiens; identical to SEQ ID NO: 280755
  misc_feature: GYAE6OF01BPGG3.37.53.E09.1.454.CMB.1.raw
  modified_base (171)..(171): a, c, t, g, unknown or other
  misc_feature (171)..(171): n is a, c, g, or t

SEQ ID NO: 280775 - DNA, 173 bp, Homo sapiens; identical to SEQ ID NO: 280765
  misc_feature: GYAE6OF01DAAKP.37.53.E09.1.454.CMB.1.raw
  modified_base (173)..(173): a, c, t, g, unknown or other
  misc_feature (173)..(173): n is a, c, g, or t

SEQ ID NO: 280776 - DNA, 173 bp, Homo sapiens; identical to SEQ ID NO: 280765
  misc_feature: GYAE6OF01DP66N.37.53.E09.1.454.CMB.1.raw
  modified_base (173)..(173): a, c, t, g, unknown or other
  misc_feature (173)..(173): n is a, c, g, or t

SEQ ID NO: 280777 - DNA, 173 bp, Homo sapiens; identical to SEQ ID NO: 280765
  misc_feature: GYAE6OF01CYYP7.37.53.E09.1.454.CMB.1.raw
  modified_base (173)..(173): a, c, t, g, unknown or other
  misc_feature (173)..(173): n is a, c, g, or t

SEQ ID NO: 280778 - DNA, 178 bp, Homo sapiens
  misc_feature: GYAE6OF01C0BT6.37.53.E09.1.454.CMB.1.raw
  modified_base (173)..(178): a, c, t, g, unknown or other
  misc_feature (173)..(178): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagnnnnnn

SEQ ID NO: 280779 - DNA, 172 bp, Homo sapiens; identical to SEQ ID NO: 280768
  misc_feature: GYAE6OF01CNRHB.37.53.E09.1.454.CMB.1.raw
  modified_base (172)..(172): a, c, t, g, unknown or other
  misc_feature (172)..(172): n is a, c, g, or t

SEQ ID NO: 280780 - DNA, 173 bp, Homo sapiens; identical to SEQ ID NO: 280765
  misc_feature: GYAE6OF01DHYMY.37.53.E09.1.454.CMB.1.raw
  modified_base (173)..(173): a, c, t, g, unknown or other
  misc_feature (173)..(173): n is a, c, g, or t

SEQ ID NO: 280781 - DNA, 173 bp, Homo sapiens; identical to SEQ ID NO: 280765
  misc_feature: GYAE6OF01B16VW.37.53.E09.1.454.CMB.1.raw
  modified_base (173)..(173): a, c, t, g, unknown or other
  misc_feature (173)..(173): n is a, c, g, or t

SEQ ID NO: 280782 - DNA, 194 bp, Homo sapiens
  misc_feature: GYAE6OF01BV7WO.37.53.E09.1.454.CMB.1.raw
  modified_base (174)..(194): a, c, t, g, unknown or other
  misc_feature (174)..(194): n is a, c, g, or t
tcagtagtgtagatcacgaccggtgctcgatttagagagagtgtgttgggtttgggggaagaggaagactgacggtcccccaggagttcaggtgctgggccacagcggccctgggctgcctggtcaaggactacttccatctacactactgagcgggctggcaaggcgcatagnnnnnnnnnnnnnnnnnnnnn

SEQ ID NO: 280783 - DNA, 173 bp, Homo sapiens; identical to SEQ ID NO: 280765
  misc_feature: GYAE6OF01BHNOV.37.53.E09.1.454.CMB.1.raw
  modified_base (173)..(173): a, c, t, g, unknown or other
  misc_feature (173)..(173): n is a, c, g, or t

SEQ ID NO: 280784 - DNA, 172 bp, Homo sapiens
  misc_feature: GYAE6OF01BFVET.37.53.E09.1.454.CMB.1.raw
  modified_base (172)..(172): a, c, t, g, unknown or other
  misc_feature (172)..(172): n is a, c, g, or t
tcagtagtgtagatcacgaccggtgctcgatttagagagagtgtgttgggtttggggaagaggaagactgacggtcccccaggagttcaggtgctgggcacagcggccctgggctgcctggtcaaggactacttccatctacactactgagcgggctggcaaggcgcatagn

SEQ ID NO: 280785 - DNA, 178 bp, Homo sapiens
  misc_feature: GYAE6OF01C3FY6.37.53.E09.1.454.CMB.1.raw
  modified_base (169)..(169): a, c, t, g, unknown or other
  misc_feature (169)..(169): n is a, c, g, or t
  modified_base (175)..(178): a, c, t, g, unknown or other
  misc_feature (175)..(178): n is a, c, g, or t
tcagtagtgtagatcacgaccggtgctcgatttagagagagtgtggttggggtttgggggaagaggaagactgaccggtcccccaggagttcaggtgctgggcacagcggccctgggctgcctggtcaaggctacttccatctacactactgagcgggctggcaaggcncatagnnnn

SEQ ID NO: 280786 - DNA, 171 bp, Homo sapiens
  misc_feature: GYAE6OF01C4HEU.37.53.E09.1.454.CMB.1.raw
  modified_base (171)..(171): a, c, t, g, unknown or other
  misc_feature (171)..(171): n is a, c, g, or t
tcagtagtgtagatcacgaccggtgctcgatttagagagagtgtgttgggtttgggggaagaggaagactgacggtccccaggagttcaggtgctgggcacagcggccctgggctgcctggtcaaggactacttccatctacactactgagcggctggcaaggcgcatagn

SEQ ID NO: 280787 - DNA, 174 bp, Homo sapiens; identical to SEQ ID NO: 280770
  misc_feature: GYAE6OF01BTISE.37.53.E09.1.454.CMB.1.raw
  modified_base (173)..(174): a, c, t, g, unknown or other
  misc_feature (173)..(174): n is a, c, g, or t

SEQ ID NO: 280788 - DNA, 187 bp, Homo sapiens
  misc_feature: GYAE6OF01BGTSM.37.53.E09.1.454.CMB.1.raw
  modified_base (173)..(187): a, c, t, g, unknown or other
  misc_feature (173)..(187): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagnnnnnnnnnnnnnnn

SEQ ID NO: 280789 - DNA, 173 bp, Homo sapiens; identical to SEQ ID NO: 280765
  misc_feature: GYAE6OF01EM356.37.53.E09.1.454.CMB.1.raw
  modified_base (173)..(173): a, c, t, g, unknown or other
  misc_feature (173)..(173): n is a, c, g, or t

SEQ ID NO: 280790 - DNA, 174 bp, Homo sapiens; identical to SEQ ID NO: 280770
  misc_feature: GYAE6OF01BNSPH.37.53.E09.1.454.CMB.1.raw
  modified_base (173)..(174): a, c, t, g, unknown or other
  misc_feature (173)..(174): n is a, c, g, or t

SEQ ID NO: 280791 - DNA, 173 bp, Homo sapiens; identical to SEQ ID NO: 280765
  misc_feature: GYAE6OF01B6XE5.37.53.E09.1.454.CMB.1.raw
  modified_base (173)..(173): a, c, t, g, unknown or other
  misc_feature (173)..(173): n is a, c, g, or t

SEQ ID NO: 280792 - DNA, 173 bp, Homo sapiens; identical to SEQ ID NO: 280765
  misc_feature: GYAE6OF01BJEO9.37.53.E09.1.454.CMB.1.raw
  modified_base (173)..(173): a, c, t, g, unknown or other
  misc_feature (173)..(173): n is a, c, g, or t

SEQ ID NO: 280793 - DNA, 171 bp, Homo sapiens
  misc_feature: GYAE6OF01AQ067.37.53.E09.1.454.CMB.1.raw
tcagtagtgtagatcacgaccggtgctcgatttagagagagtgtgttgggtttggggaagaggaagactgacggtcccccaggagttcaggtgctgggcacagcggccctgggctgcctggtcaaggactacttccatctacactactgagcgggctggcaaggcgcatag

SEQ ID NO: 280794 - DNA, 173 bp, Homo sapiens; identical to SEQ ID NO: 280765
  misc_feature: GYAE6OF01B3JXP.37.53.E09.1.454.CMB.1.raw
  modified_base (173)..(173): a, c, t, g, unknown or other
  misc_feature (173)..(173): n is a, c, g, or t

SEQ ID NO: 280795 - DNA, 174 bp, Homo sapiens; identical to SEQ ID NO: 280770
  misc_feature: GYAE6OF01D9VNM.37.53.E09.1.454.CMB.1.raw
  modified_base (173)..(174): a, c, t, g, unknown or other
  misc_feature (173)..(174): n is a, c, g, or t

SEQ ID NO: 280796 - DNA, 178 bp, Homo sapiens; identical to SEQ ID NO: 280778
  misc_feature: GYAE6OF01CRUYI.37.53.E09.1.454.CMB.1.raw
  modified_base (173)..(178): a, c, t, g, unknown or other
  misc_feature (173)..(178): n is a, c, g, or t

SEQ ID NO: 280797 - DNA, 174 bp, Homo sapiens; identical to SEQ ID NO: 280770
  misc_feature: GYAE6OF01CVD3Q.37.53.E09.1.454.CMB.1.raw
  modified_base (173)..(174): a, c, t, g, unknown or other
  misc_feature (173)..(174): n is a, c, g, or t

SEQ ID NO: 280798 - DNA, 175 bp, Homo sapiens
  misc_feature: GYAE6OF01DG22Y.37.53.E09.1.454.CMB.1.raw
  modified_base (173)..(175): a, c, t, g, unknown or other
  misc_feature (173)..(175): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagnnn

SEQ ID NO: 280799 - DNA, 174 bp, Homo sapiens
  misc_feature: GYAE6OF01AOZD7.37.53.E09.1.454.CMB.1.raw
  modified_base (173)..(174): a, c, t, g, unknown or other
  misc_feature (173)..(174): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaatgactacttccatctacactactgagcgggctggcaaggcgcatagnn

SEQ ID NO: 280800 - DNA, 174 bp, Homo sapiens
  misc_feature: GYAE6OF01BL4U6.37.53.E09.1.454.CMB.1.raw
  modified_base (173)..(174): a, c, t, g, unknown or other
  misc_feature (173)..(174): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactaatgagcgggctggcaaggcgcatagnn

SEQ ID NO: 280801 - DNA, 200 bp, Homo sapiens
  misc_feature: GYAE6OF01BIEK9.37.53.E09.1.454.CMB.1.raw
  modified_base (176)..(200): a, c, t, g, unknown or other
  misc_feature (176)..(200): n is a, c, g, or t
tcagtagtgtagatcacgaccggtgctcgatttagagagagtgtgttgggtttgggggaagaggaaggacttgacggtcccccaggagttcaggtgctgggcacagcggaccctgggctgcctggtcaaggactacttccatctacactactgagcgggctggcaaggcgcatagnnnnnnnnnnnnnnnnnnnnnnnnn

SEQ ID NO: 280802 - DNA, 172 bp, Homo sapiens
  misc_feature: GYAE6OF01D1E0N.37.53.E09.1.454.CMB.1.raw
  modified_base (172)..(172): a, c, t, g, unknown or other
  misc_feature (172)..(172): n is a, c, g, or t
tcagtagtgtagatcacgaccggtgctcgatttagagagagtgtgttgggttgggggaagaggaagactgacggtcccccaggagttcaggtgctgggcacagcggccctgggctgcctggtcaaggactacttccatctacactactgagcgggctggcaaggcgcatagn

SEQ ID NO: 280803 - DNA, 172 bp, Homo sapiens
  misc_feature: GYAE6OF01AMMPF.37.53.E09.1.454.CMB.1.raw
  modified_base (172)..(172): a, c, t, g, unknown or other
  misc_feature (172)..(172): n is a, c, g, or t
tcagtagtgtagatcacgaccggtgctcgatttagagagagtgtgttgggtttggggaagaggaagactgaccggtccccaggagttcaggtgctgggcacagcggccctgggctgcctggtcaaggactacttccatctacactactgagcgggctggcaaggcgcatagn

SEQ ID NO: 280804 - DNA, 173 bp, Homo sapiens; identical to SEQ ID NO: 280765
  misc_feature: GYAE6OF01B3NBQ.37.53.E09.1.454.CMB.1.raw
  modified_base (173)..(173): a, c, t, g, unknown or other
  misc_feature (173)..(173): n is a, c, g, or t

SEQ ID NO: 280805 - DNA, 173 bp, Homo sapiens; identical to SEQ ID NO: 280765
  misc_feature: GYAE6OF01E4I9Q.37.53.E09.1.454.CMB.1.raw
  modified_base (173)..(173): a, c, t, g, unknown or other
  misc_feature (173)..(173): n is a, c, g, or t

SEQ ID NO: 280806 - DNA, 174 bp, Homo sapiens; identical to SEQ ID NO: 280770
  misc_feature: GYAE6OF01EM4RI.37.53.E09.1.454.CMB.1.raw
  modified_base (173)..(174): a, c, t, g, unknown or other
  misc_feature (173)..(174): n is a, c, g, or t

SEQ ID NO: 280807 - DNA, 173 bp, Homo sapiens; identical to SEQ ID NO: 280765
  misc_feature: GYAE6OF01DTYWU.37.53.E09.1.454.CMB.1.raw
  modified_base (173)..(173): a, c, t, g, unknown or other
  misc_feature (173)..(173): n is a, c, g, or t

SEQ ID NO: 280808 - DNA, 173 bp, Homo sapiens; identical to SEQ ID NO: 280765
  misc_feature: GYAE6OF01CLBI5.37.53.E09.1.454.CMB.1.raw
  modified_base (173)..(173): a, c, t, g, unknown or other
  misc_feature (173)..(173): n is a, c, g, or t

SEQ ID NO: 280809 - DNA, 203 bp, Homo sapiens
  misc_feature: GYAE6OF01D0ISS.37.53.E09.1.454.CMB.1.raw
  modified_base (173)..(173): a, c, t, g, unknown or other
  misc_feature (173)..(173): n is a, c, g, or t
  modified_base (179)..(203): a, c, t, g, unknown or other
  misc_feature (179)..(203): n is a, c, g, or t
tcagtagtgtagatcacgaccggtgctcgatttagagagagtgtgttggggtttggggggaagaggaagacctgacggtcccccaggagttcaggtgctgggcacgacgcggccctgggctgcctgggtcaaggctacttccatcgtacactactgagcgggctggcaaggcncatagnnnnnnnnnnnnnnnnnnnnnnnnn

SEQ ID NO: 280810 - DNA, 188 bp, Homo sapiens
  misc_feature: GYAE6OF01A9XPD.37.53.E09.1.454.CMB.1.raw
  modified_base (167)..(167): a, c, t, g, unknown or other
  misc_feature (167)..(167): n is a, c, g, or t
  modified_base (173)..(188): a, c, t, g, unknown or other
  misc_feature (173)..(188): n is a, c, g, or t
tcagtagtgtagatcacgaccggtgctcgatttagagagagtgtgttgggtttgggggaagaggaagactgaccggtcccccaggagttcaggtgctgggacacagcggccctgggctgcctggtcaaggctacttccatctacactactgagcggctggcaaggcncatagnnnnnnnnnnnnnnnn

SEQ ID NO: 280811 - DNA, 174 bp, Homo sapiens; identical to SEQ ID NO: 280770
  misc_feature: GYAE6OF01CQJ7E.37.53.E09.1.454.CMB.1.raw
  modified_base (173)..(174): a, c, t, g, unknown or other
  misc_feature (173)..(174): n is a, c, g, or t

SEQ ID NO: 280812 - DNA, 199 bp, Homo sapiens
  misc_feature: GYAE6OF01BL6N5.37.53.E09.1.454.CMB.1.raw
  modified_base (142)..(142): a, c, t, g, unknown or other
  misc_feature (142)..(142): n is a, c, g, or t
  modified_base (173)..(199): a, c, t, g, unknown or other
  misc_feature (173)..(199): n is a, c, g, or t
tcagtagtgtagatcacgaccggtgctcgatttagagagagtgtgttgggtttgggggaagaggaagactgacggtccccaggagttcaggtgctgggcacagcggcctgggctgcctggtcaaggactacttccatcgtanactactgagcgggcttggcaaggcgcatagnnnnnnnnnnnnnnnnnnnnnnnnnnn

SEQ ID NO: 280813 - DNA, 225 bp, Homo sapiens
  misc_feature: GYAE6OF01B3UX4.37.53.E09.1.454.CMB.1.raw
  modified_base (173)..(173): a, c, t, g, unknown or other
  misc_feature (173)..(173): n is a, c, g, or t
  modified_base (179)..(182): a, c, t, g, unknown or other
  misc_feature (179)..(182): n is a, c, g, or t
  modified_base (184)..(186): a, c, t, g, unknown or other
  misc_feature (184)..(186): n is a, c, g, or t
  modified_base (188)..(225): a, c, t, g, unknown or other
  misc_feature (188)..(225): n is a, c, g, or t
tcagtagtgtagatcacgaccggtgctcgatttagagagagtgtgttggggtttaggggggaagaggaagactgacggtcccccaggagttcgaggtgcgtgggccacagcggccctgggctgcctggtcaaggactacttccatctacactactgagcgggctggcaaggcncatagnnnntnnngnnnnnnnnnnnnnnnnnnnnnnnnnnnnnnnnnnnnnn

SEQ ID NO: 280814 - DNA, 174 bp, Homo sapiens; identical to SEQ ID NO: 280770
  misc_feature: GYAE6OF01AXQ4Y.37.53.E09.1.454.CMB.1.raw
  modified_base (173)..(174): a, c, t, g, unknown or other
  misc_feature (173)..(174): n is a, c, g, or t

SEQ ID NO: 280815 - DNA, 176 bp, Homo sapiens
  misc_feature: GYAE6OF01CN2AA.37.53.E09.1.454.CMB.1.raw
  modified_base (174)..(176): a, c, t, g, unknown or other
  misc_feature (174)..(176): n is a, c, g, or t
tcagtagtgtagatcacgaccggtgctcgatttagagagagtgtgttgggtttgggggaagaggaagactgaccggtcccccaggagttcaggtgctgggcacagcggccctgggctgcctggtcaaggactacttccatctacactactgagcgggctggcaaggcgcatagnnn

SEQ ID NO: 280816 - DNA, 177 bp, Homo sapiens
  misc_feature: GYAE6OF01EXE9X.37.53.E09.1.454.CMB.1.raw
  modified_base (174)..(177): a, c, t, g, unknown or other
  misc_feature (174)..(177): n is a, c, g, or t
tcagtagtgtagatcacgaccggtgctcgatttagagagagtgtgttgggtttgggggaagaggaagactgaccggtcccccaggagttcaggtgctgggcacagcggccctgggctgcctggtcaaggactacttccatctacactactgagcgggctggcaaggcgcatagnnnn

SEQ ID NO: 280817 - DNA, 186 bp, Homo sapiens
  misc_feature: GYAE6OF01DFQND.37.53.E09.1.454.CMB.1.raw
  modified_base (174)..(186): a, c, t, g, unknown or other
  misc_feature (174)..(186): n is a, c, g, or t
tcagtagtgtagatcacgaccggtgctcgatttagagagagtgtgttgggtttggggggaagaggaagactgacggtcccccaggagttcaggtgctgggcacagcggccctgggctgcctggtcaaggactacttccatctacactactgagcgggctggcaaggcgcatagnnnnnnnnnnnnn

SEQ ID NO: 280818 - DNA, 173 bp, Homo sapiens; identical to SEQ ID NO: 280765
  misc_feature: GYAE6OF01AIHZW.37.53.E09.1.454.CMB.1.raw
  modified_base (173)..(173): a, c, t, g, unknown or other
  misc_feature (173)..(173): n is a, c, g, or t

SEQ ID NO: 280819 - DNA, 218 bp, Homo sapiens
  misc_feature: GYAE6OF01ENAN2.37.53.E09.1.454.CMB.1.raw
  modified_base (182)..(218): a, c, t, g, unknown or other
  misc_feature (182)..(218): n is a, c, g, or t
tcagtagtgtagatcacgaccggtgctcgatttagagagagtgtggttgggtttggggggggaagaggaagactgacggtccccccaggagttcgaggtgctgggcacagcggccctgggctgcctggtcaaggactacttccatctacactacgtggaggcgggctggcaaggcgcatagnnnnnnnnnnnnnnnnnnnnnnnnnnnnnnnnnnnnn

SEQ ID NO: 280820 - DNA, 173 bp, Homo sapiens; identical to SEQ ID NO: 280765
  misc_feature: GYAE6OF01BX4I5.37.53.E09.1.454.CMB.1.raw
  modified_base (173)..(173): a, c, t, g, unknown or other
  misc_feature (173)..(173): n is a, c, g, or t

SEQ ID NO: 280821 - DNA, 174 bp, Homo sapiens; identical to SEQ ID NO: 280770
  misc_feature: GYAE6OF01BJ4UL.37.53.E09.1.454.CMB.1.raw
  modified_base (173)..(174): a, c, t, g, unknown or other
  misc_feature (173)..(174): n is a, c, g, or t

SEQ ID NO: 280822 - DNA, 212 bp, Homo sapiens
  misc_feature: GYAE6OF01EPT01.37.53.E09.1.454.CMB.1.raw
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (180)..(212): a, c, t, g, unknown or other
  misc_feature (180)..(212): n is a, c, g, or t
tcagtagtgtagatcacgaccggtgctcgatttagagagagtgtgttggggtttggggggaagaggaagactgacggtccccccagggagttcaggtgctgggcacagccggccctgggctgcctggtcaaggactacttccatctaacactactgagcggctggcaaggcncatagngnnnnnnnnnnnnnnnnnnnnnnnnnnnnnnnnn

SEQ ID NO: 280823 - DNA, 176 bp, Homo sapiens
  misc_feature: GYAE6OF01BZYOG.37.53.E09.1.454.CMB.1.raw
  modified_base (173)..(176): a, c, t, g, unknown or other
  misc_feature (173)..(176): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatagnnnn

SEQ ID NO: 280824 - DNA, 176 bp, Homo sapiens
  misc_feature: GYAE6OF01A8G6Y.37.53.E09.1.454.CMB.1.raw
  modified_base (172)..(176): a, c, t, g, unknown or other
  misc_feature (172)..(176): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcggctggcaaggcgcatagnnnnn

SEQ ID NO: 280825 - DNA, 174 bp, Homo sapiens
  misc_feature: GYAE6OF01A4NPA.37.53.E09.1.454.CMB.1.raw
  modified_base (174)..(174): a, c, t, g, unknown or other
  misc_feature (174)..(174): n is a, c, g, or t
tcagtagtgtagatcacgaccggtgctcgatttagagagagtgtgttgggtttggggggaagaggaagactgacggtcccccaggagttcaggtgctgggcacagcggccctgggctgcctggtcaaggactacttccatctacactactgagcgggctggcaaggcgcatagn

SEQ ID NO: 280826 - DNA, 269 bp, Homo sapiens
  misc_feature: GYAE6OF01DHL1C.37.53.E09.1.454.CMB.1.raw
  modified_base (182)..(182): a, c, t, g, unknown or other
  misc_feature (182)..(182): n is a, c, g, or t
  modified_base (188)..(269): a, c, t, g, unknown or other
  misc_feature (188)..(269): n is a, c, g, or t
tcagtagtgtagatcacgaccggtgctcgatttagagagagtgtgttggggtttggggggaagaggaagactgaccggtccccccaggagttcagggtgctgggcacagcggcctgggctgcctggtcaaggctacttccatctacactactgagcgggctagggcaagggccgcagtaggntgcagnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 280827 - DNA, 202 bp, Homo sapiens
  misc_feature: GYAE6OF01BCPGN.37.53.E09.1.454.CMB.1.raw
  modified_base (174)..(202): a, c, t, g, unknown or other
  misc_feature (174)..(202): n is a, c, g, or t
tcagtagtgtagatcacgaccggtgctcgatttagagagagtgtgttgggtttgggggaagaggaagactgacggtcccccaggagttcaggtgcctgggcacagcggccctgggctgcctggtcaaggactacttccatctacactactgagcgggctggcaaggcgcatagnnnnnnnnnnnnnnnnnnnnnnnnnnnnn

SEQ ID NO: 280828 - DNA, 171 bp, Homo sapiens; identical to SEQ ID NO: 280755
  misc_feature: GYAE6OF02F6WF4.37.53.E09.1.454.CMB.1.raw
  modified_base (171)..(171): a, c, t, g, unknown or other
  misc_feature (171)..(171): n is a, c, g, or t

SEQ ID NO: 280829 - DNA, 173 bp, Homo sapiens; identical to SEQ ID NO: 280765
  misc_feature: GYAE6OF02G2LQD.37.53.E09.1.454.CMB.1.raw
  modified_base (173)..(173): a, c, t, g, unknown or other
  misc_feature (173)..(173): n is a, c, g, or t

SEQ ID NO: 280830 - DNA, 173 bp, Homo sapiens; identical to SEQ ID NO: 280765
  misc_feature: GYAE6OF02ITWAE.37.53.E09.1.454.CMB.1.raw
  modified_base (173)..(173): a, c, t, g, unknown or other
  misc_feature (173)..(173): n is a, c, g, or t

SEQ ID NO: 280831 - DNA, 177 bp, Homo sapiens
  misc_feature: GYAE6OF02H9JY8.37.53.E09.1.454.CMB.1.raw
  modified_base (174)..(177): a, c, t, g, unknown or other
  misc_feature (174)..(177): n is a, c, g, or t
tcagtagtgtagatcacgaccggtgctcgatttagagagagtgtgttgggtttgggggaagaggaagactgacggtcccccacggagttcaggtgctgggcacagcggccctgggctgcctggtcaaggactacttccatctacactactgagcgggctggcaaggcgcatagnnnn

SEQ ID NO: 280832 - DNA, 172 bp, Homo sapiens; identical to SEQ ID NO: 280784
  misc_feature: GYAE6OF02IYY8Z.37.53.E09.1.454.CMB.1.raw
  modified_base (172)..(172): a, c, t, g, unknown or other
  misc_feature (172)..(172): n is a, c, g, or t

SEQ ID NO: 280833 - DNA, 172 bp, Homo sapiens; identical to SEQ ID NO: 280773
  misc_feature: GYAE6OF02GACQ6.37.53.E09.1.454.CMB.1.raw
  modified_base (171)..(172): a, c, t, g, unknown or other
  misc_feature (171)..(172): n is a, c, g, or t

SEQ ID NO: 280834 - DNA, 203 bp, Homo sapiens
  misc_feature: GYAE6OF02JBJDX.37.53.E09.1.454.CMB.1.raw
  modified_base (174)..(203): a, c, t, g, unknown or other
  misc_feature (174)..(203): n is a, c, g, or t
tcagtagtgtagatcacgaccggtgctcgatttagagagagtgtgttgggttgggggaagaggaagactgacggtcccccaggaggttcaggtgctgggcacagcggccctgggctgcctggtcaaggctacttccatctacactactgagcgggctgggcaaggcgcatagcnnnnnnnnnnnnnnnnnnnnnnnnnnnnnn

SEQ ID NO: 280835 - DNA, 174 bp, Homo sapiens; identical to SEQ ID NO: 280770
  misc_feature: GYAE6OF02HF0VH.37.53.E09.1.454.CMB.1.raw
  modified_base (173)..(174): a, c, t, g, unknown or other
  misc_feature (173)..(174): n is a, c, g, or t

SEQ ID NO: 280836 - DNA, 173 bp, Homo sapiens; identical to SEQ ID NO: 280765
  misc_feature: GYAE6OF02F433I.37.53.E09.1.454.CMB.1.raw
  modified_base (173)..(173): a, c, t, g, unknown or other
  misc_feature (173)..(173): n is a, c, g, or t

SEQ ID NO: 280837 - DNA, 173 bp, Homo sapiens; identical to SEQ ID NO: 280765
  misc_feature: GYAE6OF02F19S9.37.53.E09.1.454.CMB.1.raw
  modified_base (173)..(173): a, c, t, g, unknown or other
  misc_feature (173)..(173): n is a, c, g, or t

SEQ ID NO: 280838 - DNA, 173 bp, Homo sapiens; identical to SEQ ID NO: 280765
  misc_feature: GYAE6OF02HHG18.37.53.E09.1.454.CMB.1.raw
  modified_base (173)..(173): a, c, t, g, unknown or other
  misc_feature (173)..(173): n is a, c, g, or t

SEQ ID NO: 280839 - DNA, 173 bp, Homo sapiens; identical to SEQ ID NO: 280765
  misc_feature: GYAE6OF02FWLUN.37.53.E09.1.454.CMB.1.raw
  modified_base (173)..(173): a, c, t, g, unknown or other
  misc_feature (173)..(173): n is a, c, g, or t

SEQ ID NO: 280840 - DNA, 172 bp, Homo sapiens
  misc_feature: GYAE6OF02JFOLX.37.53.E09.1.454.CMB.1.raw
  modified_base (170)..(172): a, c, t, g, unknown or other
  misc_feature (170)..(172): n is a, c, g, or t
tcagtagtgtagatcacgaccggtgctcgatttagagagagtgtgttgggttggggaagaggaagactgacggtccccaggagttcaggtgctgggcacagcggccctgggctgcctggtcaaggactacttccatctacactactgagcgggctggcaaggcgcatagnnn

SEQ ID NO: 280841 - DNA, 173 bp, Homo sapiens; identical to SEQ ID NO: 280765
  misc_feature: GYAE6OF02FTKYS.37.53.E09.1.454.CMB.1.raw
  modified_base (173)..(173): a, c, t, g, unknown or other
  misc_feature (173)..(173): n is a, c, g, or t

SEQ ID NO: 280842 - DNA, 182 bp, Homo sapiens
  misc_feature: GYAE6OF02F046R.37.53.E09.1.454.CMB.1.raw
  modified_base (174)..(182): a, c, t, g, unknown or other
  misc_feature (174)..(182): n is a, c, g, or t
tcagtagtgtagatcacgaccggtgctcgatttagagagagtgtgttgggtttgggggaaggaggaagactgacggtcccccaggagttcaggtgctgggcacagcggccctgggctgcctggtcaaggactacttccatctacactactgagcgggctggcaaggcgcatagnnnnnnnnn

SEQ ID NO: 280843 - DNA, 177 bp, Homo sapiens; identical to SEQ ID NO: 280764
  misc_feature: GYAE6OF02HZAQI.37.53.E09.1.454.CMB.1.raw
  modified_base (173)..(177): a, c, t, g, unknown or other
  misc_feature (173)..(177): n is a, c, g, or t

SEQ ID NO: 280844 - DNA, 597 bp, Homo sapiens
  misc_feature: GYAE6OF02GWSZS.37.53.E09.1.454.CMB.1.raw
  modified_base (188)..(188): a, c, t, g, unknown or other
  misc_feature (188)..(188): n is a, c, g, or t
  modified_base (190)..(192): a, c, t, g, unknown or other
  misc_feature (190)..(192): n is a, c, g, or t
  modified_base (194)..(197): a, c, t, g, unknown or other
  misc_feature (194)..(197): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
tcagtagtgtagatcacgaccggtgctcgatttagagagagtgtggttggggtttcgggggaagaggaagactgacggtcccccaggagttcaggtgctgggcacctagcggccttggctggcctggtcaaggactacttccagtcgtacacgtactggaagcgggctggctaacggcgcagtacgancnnngnnnnagcatncntntcagntacagcganatcatgtgactgcgtgctgaacgccagnaggacaggaacgaccggcgcgcgttntctgtgngacgcgtccgtactacgaggcgtacgacgtaggtacgcgacgtacgtagtacgtacgtcggacggacgacgtacgtacgtacgtctacctacacgacctaccgaccgaccggaccgacgtaccgtccgttcccgtacgtccgtaccttaccgtacctaaccgtacgtaccgtaccgtccgtacggtacgtacgacgaccgtccgtcgttcgttcgtccggtcggtacggtaacgtacgtaccgtacgtacgtacgacgtacgtacgtcggtacggtcggtcgtacgacgacgtcgtacgtacgtacgtcgtcgtc

SEQ ID NO: 280845 - DNA, 184 bp, Homo sapiens
  misc_feature: GYAE6OF02GY7BN.37.53.E09.1.454.CMB.1.raw
  modified_base (174)..(184): a, c, t, g, unknown or other
  misc_feature (174)..(184): n is a, c, g, or t
tcagtagtgtagatcacgaccggtgctcgatttagagagagtgtgttgggtttgggggaagaggaagactgacgggtcccccaggagttcaggtgctgggcacagcggccctgggctgcctggtcaaggactacttccatctacactactgagcgggctggcaaggcgcatagnnnnnnnnnnn

SEQ ID NO: 280846 - DNA, 175 bp, Homo sapiens; identical to SEQ ID NO: 280798
  misc_feature: GYAE6OF02HJZ3S.37.53.E09.1.454.CMB.1.raw
  modified_base (173)..(175): a, c, t, g, unknown or other
  misc_feature (173)..(175): n is a, c, g, or t

SEQ ID NO: 280847 - DNA, 173 bp, Homo sapiens; identical to SEQ ID NO: 280765
  misc_feature: GYAE6OF02IPC0O.37.53.E09.1.454.CMB.1.raw
  modified_base (173)..(173): a, c, t, g, unknown or other
  misc_feature (173)..(173): n is a, c, g, or t

SEQ ID NO: 280848 - DNA, 173 bp, Homo sapiens; identical to SEQ ID NO: 280765
  misc_feature: GYAE6OF02HBMRO.37.53.E09.1.454.CMB.1.raw
  modified_base (173)..(173): a, c, t, g, unknown or other
  misc_feature (173)..(173): n is a, c, g, or t

SEQ ID NO: 280849 - DNA, 173 bp, Homo sapiens; identical to SEQ ID NO: 280765
  misc_feature: GYAE6OF02GDWLU.37.53.E09.1.454.CMB.1.raw
  modified_base (173)..(173): a, c, t, g, unknown or other
  misc_feature (173)..(173): n is a, c, g, or t

SEQ ID NO: 280850 - DNA, 174 bp, Homo sapiens
  misc_feature: GYAE6OF02IQT69.37.53.E09.1.454.CMB.1.raw
  modified_base (171)..(174): a, c, t, g, unknown or other
  misc_feature (171)..(174): n is a, c, g, or t
tcagtagtgtagatcacgaccggtgctcgatttagagagagtgtgttgggttgggggaagaggaagactgacggtccccaggagttcaggtgctgggcacagcggccctgggctgcctggtcaaggactacttccatctacactactgagcgggctggcaaggcgcatagnnnn

SEQ ID NO: 280851 - DNA, 173 bp, Homo sapiens; identical to SEQ ID NO: 280765
  misc_feature: GYAE6OF02IK0WZ.37.53.E09.1.454.CMB.1.raw
  modified_base (173)..(173): a, c, t, g, unknown or other
  misc_feature (173)..(173): n is a, c, g, or t

SEQ ID NO: 280852 - DNA, 176 bp, Homo sapiens; identical to SEQ ID NO: 280823
  misc_feature: GYAE6OF02GX2JN.37.53.E09.1.454.CMB.1.raw
  modified_base (173)..(176): a, c, t, g, unknown or other
  misc_feature (173)..(176): n is a, c, g, or t

SEQ ID NO: 280853 - DNA, 173 bp, Homo sapiens; identical to SEQ ID NO: 280765
  misc_feature: GYAE6OF02HL50U.37.53.E09.1.454.CMB.1.raw
  modified_base (173)..(173): a, c, t, g, unknown or other
  misc_feature (173)..(173): n is a, c, g, or t

SEQ ID NO: 280854 - DNA, 240 bp, Homo sapiens
  misc_feature: GYAE6OF02HJY96.37.53.E09.1.454.CMB.1.raw
  modified_base (176)..(177): a, c, t, g, unknown or other
  misc_feature (176)..(177): n is a, c, g, or t
  modified_base (179)..(182): a, c, t, g, unknown or other
  misc_feature (179)..(182): n is a, c, g, or t
  modified_base (185)..(186): a, c, t, g, unknown or other
  misc_feature (185)..(186): n is a, c, g, or t
  modified_base (189)..(190): a, c, t, g, unknown or other
  misc_feature (189)..(190): n is a, c, g, or t
  modified_base (192)..(240): a, c, t, g, unknown or other
  misc_feature (192)..(240): n is a, c, g, or t
tcagtagtgtagatcacgaccggtgctcgatttagagagagtgtgtttggggtttgggggggaagaggaagactgacggtcccccaggagttcaggtgctgggcacagcggccctggctgcctggtcaaggactacttccatctacactactgagcgggctggcaaggcgcatagnngnnnnagnngcnncnnnnnnnnnnnnnnnnnnnnnnnnnnnnnnnnnnnnnnnnnnnnnnnnn

SEQ ID NO: 280855 - DNA, 178 bp, Homo sapiens; identical to SEQ ID NO: 280778
  misc_feature: GYAE6OF02JF8YP.37.53.E09.1.454.CMB.1.raw
  modified_base (173)..(178): a, c, t, g, unknown or other
  misc_feature (173)..(178): n is a, c, g, or t

SEQ ID NO: 280856 - DNA, 175 bp, Homo sapiens; identical to SEQ ID NO: 280798
  misc_feature: GYAE6OF02JYG6L.37.53.E09.1.454.CMB.1.raw
  modified_base (173)..(175): a, c, t, g, unknown or other
  misc_feature (173)..(175): n is a, c, g, or t

SEQ ID NO: 280857 - DNA, 175 bp, Homo sapiens; identical to SEQ ID NO: 280798
  misc_feature: GYAE6OF02FWSO2.37.53.E09.1.454.CMB.1.raw
  modified_base (173)..(175): a, c, t, g, unknown or other
  misc_feature (173)..(175): n is a, c, g, or t

SEQ ID NO: 280858 - DNA, 175 bp, Homo sapiens; identical to SEQ ID NO: 280798
  misc_feature: GYAE6OF02HON0C.37.53.E09.1.454.CMB.1.raw
  modified_base (173)..(175): a, c, t, g, unknown or other
  misc_feature (173)..(175): n is a, c, g, or t

SEQ ID NO: 280859 - DNA, 172 bp, Homo sapiens
  misc_feature: GYAE6OF02FRQ3E.37.53.E09.1.454.CMB.1.raw
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgcatag

SEQ ID NO: 280860 - DNA, 178 bp, Homo sapiens
  misc_feature: GYAE6OF02GUG8K.37.53.E09.1.454.CMB.1.raw
  modified_base (174)..(178): a, c, t, g, unknown or other
  misc_feature (174)..(178): n is a, c, g, or t
tcagtagtgtagatcacgaccggtgctcgatttagagagagtgtgttgggttgggggaagaggaagacgtgaccggtccccccaggagttcaggtgctgggcacagcggccctgggctgcctggtcaaggctacttccatctacactactgagcgggctggcaaggcgcatagnnnnn

SEQ ID NO: 280861 - DNA, 174 bp, Homo sapiens
  misc_feature: GYAE6OF02IA6XO.37.53.E09.1.454.CMB.1.raw
  modified_base (174)..(174): a, c, t, g, unknown or other
  misc_feature (174)..(174): n is a, c, g, or t
tcagtagtgtagatcacgaccggtgctcgatttagagagagtgtgttgggtttgggggaagaggaagactgacggtccccccaggagttcaggtgctgggcacagcggccctgggctgcctggtcaaggactacttccatctacactactgagcgggctggcaaggcgcatagn

SEQ ID NO: 280862 - DNA, 173 bp, Homo sapiens
  misc_feature: GYAE6OF02HC9L7.37.53.E09.1.454.CMB.1.raw
tcagtagtgtagatcacgaccggtgctcgatttagagagagtgtgttgggtttgggggaagaggaagactgaccggtcccccaggagttcaggtgctgggcacagcggccctgggctgcctggtcaaggactacttccatctacactactgagcgggctggcaaggcgcatag

SEQ ID NO: 280863 - DNA, 174 bp, Homo sapiens; identical to SEQ ID NO: 280770
  misc_feature: GYAE6OF02HYH8O.37.53.E09.1.454.CMB.1.raw
  modified_base (173)..(174): a, c, t, g, unknown or other
  misc_feature (173)..(174): n is a, c, g, or t

SEQ ID NO: 280864 - DNA, 173 bp, Homo sapiens; identical to SEQ ID NO: 280765
  misc_feature: GYAE6OF02FV8DE.37.53.E09.1.454.CMB.1.raw
  modified_base (173)..(173): a, c, t, g, unknown or other
  misc_feature (173)..(173): n is a, c, g, or t

SEQ ID NO: 280865 - DNA, 197 bp, Homo sapiens
  misc_feature: GYAE6OF02IM3XX.37.53.E09.1.454.CMB.1.raw
  modified_base (176)..(197): a, c, t, g, unknown or other
  misc_feature (176)..(197): n is a, c, g, or t
tcagtagtgtagatcacgaccggtgctcgatttagagagagtgtgttggggtttgggggaagaggaagactgacggtccccccaggagttcaggtgctgggcacagcggccctgggctgcctggtccaaggactacttccatctacactactgagcgggctggcaaggcgcatagnnnnnnnnnnnnnnnnnnnnnn

SEQ ID NO: 280866 - DNA, 177 bp, Homo sapiens; identical to SEQ ID NO: 280764
  misc_feature: GYAE6OF02G8T5Z.37.53.E09.1.454.CMB.1.raw
  modified_base (173)..(177): a, c, t, g, unknown or other
  misc_feature (173)..(177): n is a, c, g, or t

SEQ ID NO: 280867 - DNA, 168 bp, Homo sapiens
  misc_feature: GYAE6OF02FVOB4.37.53.E09.1.454.CMB.1.raw
tcagtagtgtagatcacgaccggtgctcgattagagagagtgtgttgggtttgggtaagaggaagactgacggtcccccaggagttcaggtgctgggcacagcggccctgggctgcctggtcaaggctacttccatctacactactgagcggctggcaaggcgcatag

SEQ ID NO: 280868 - DNA, 174 bp, Homo sapiens; identical to SEQ ID NO: 280770
  misc_feature: GYAE6OF02FZZ4P.37.53.E09.1.454.CMB.1.raw
  modified_base (173)..(174): a, c, t, g, unknown or other
  misc_feature (173)..(174): n is a, c, g, or t

SEQ ID NO: 280869 - DNA, 219 bp, Homo sapiens
  misc_feature: GYAE6OF02GH14P.37.53.E09.1.454.CMB.1.raw
  modified_base (178)..(219): a, c, t, g, unknown or other
  misc_feature (178)..(219): n is a, c, g, or t
tcagtagtgtagatcacgaccggtgctcgatttagagagagtgtgttgggttgggggggaagaggaagactgacggtcccccaggagttcaggtgctggggcacgagccggccctgggctcgcctggtcaaggctacttccatctacactactgagcgggctggcaaggcgcatagcnnnnnnnnnnnnnnnnnnnnnnnnnnnnnnnnnnnnnnnnnn

SEQ ID NO: 280870 - DNA, 174 bp, Homo sapiens; identical to SEQ ID NO: 280770
  misc_feature: GYAE6OF02GIHN2.37.53.E09.1.454.CMB.1.raw
  modified_base (173)..(174): a, c, t, g, unknown or other
  misc_feature (173)..(174): n is a, c, g, or t

SEQ ID NO: 280871 - DNA, 175 bp, Homo sapiens
  misc_feature: GYAE6OF02I3E1X.37.53.E09.1.454.CMB.1.raw
  modified_base (174)..(175): a, c, t, g, unknown or other
  misc_feature (174)..(175): n is a, c, g, or t
tcagtagtgtagatcacgaccggtgctcgatttagagagagtgtgttgggtttgggggaagaggaagactgacggtccccccaggagttcaggtgctgggcacagcggccctgggctgcctggtcaaggactacttccatctacactactgagcgggctggcaaggcgcatagnn

SEQ ID NO: 280872 - DNA, 177 bp, Homo sapiens
  misc_feature: GYAE6OF02GY1RN.37.53.E09.1.454.CMB.1.raw
  modified_base (174)..(177): a, c, t, g, unknown or other
  misc_feature (174)..(177): n is a, c, g, or t
tcagtagtgtagatcacgaccggtgctcgatttagagagagtgtgttgggtttggggggaagaggaagactgacggtcccccaggagttcaggtgctgggcacagcggccctgggctgcctggtcaaggactacttccatctacactactgagcgggctggcaaggcgcatagnnnn

SEQ ID NO: 280873 - DNA, 174 bp, Homo sapiens
  misc_feature: GYAE6OF02GYPYN.37.53.E09.1.454.CMB.1.raw
  modified_base (168)..(168): a, c, t, g, unknown or other
  misc_feature (168)..(168): n is a, c, g, or t
  modified_base (173)..(174): a, c, t, g, unknown or other
  misc_feature (173)..(174): n is a, c, g, or t
tcagtagtgtagatcacgaccggtgctcgatttagagagagtgtgttgggtttgggggaagaggaagactgacggtcccccaggagttcaggtgctgggcacagcggccctgggctgcctggtcaaggactacttccatctacactactgagcgggctggcaaggcgnatagnn

SEQ ID NO: 280874 - DNA, 178 bp, Homo sapiens; identical to SEQ ID NO: 280778
  misc_feature: GYAE6OF02HKKXZ.37.53.E09.1.454.CMB.1.raw
  modified_base (173)..(178): a, c, t, g, unknown or other
  misc_feature (173)..(178): n is a, c, g, or t

SEQ ID NO: 280875 - DNA, 182 bp, Homo sapiens
  misc_feature: GYAE6OF02IMSZP.37.53.E09.1.454.CMB.1.raw
  modified_base (169)..(182): a, c, t, g, unknown or other
  misc_feature (169)..(182): n is a, c, g, or t
tcagtagtgtagatcacgaccggtgctcgatttagagagagtgtgttgggttgggggaagaggaagactgacggtcccccaggagttcaggtgctgggcacagcggccctgggctgcctggtcaaggctactccatctacatactgagcggctggacaaggcgcatagnnnnnnnnnnnnnn

SEQ ID NO: 280876 - DNA, 181 bp, Homo sapiens
  misc_feature: GYAE6OF02HK3JY.37.53.E09.1.454.CMB.1.raw
  modified_base (175)..(181): a, c, t, g, unknown or other
  misc_feature (175)..(181): n is a, c, g, or t
tcagtagtgtagatcacgaccggtgctcgatttagagagagtgtgttgggtttggggggaagaggaagactgacggtccccccaggagttcaggtgctgggcacagcggccctgggctgcctggtcaaggactacttccatctacactactgagcgggctggcaaggcgcatagnnnnnnn

SEQ ID NO: 280877 - DNA, 180 bp, Homo sapiens
  misc_feature: GYAE6OF02GKDXY.37.53.E09.1.454.CMB.1.raw
  modified_base (173)..(180): a, c, t, g, unknown or other
  misc_feature (173)..(180): n is a, c, g, or t
tcagtagtgtagatcacgaccggtgctcgatttagagagagtgtgttgggtttggggggaagaggaagactgacggtcccccaggagttcaggtgctgggcacagcggccctgggctgcctggtcaaggactacttccatctacactactgagcggctggcaaggcgcatagnnnnnnnn

SEQ ID NO: 280878 - DNA, 184 bp, Homo sapiens
  misc_feature: GYAE6OF02F5QI2.37.53.E09.1.454.CMB.1.raw
  modified_base (174)..(184): a, c, t, g, unknown or other
  misc_feature (174)..(184): n is a, c, g, or t
tcagtagtgtagatcacgaccggtgctcgatttagagagagtgtgttgggtttgggggaagaggaagactgacggtccccccaggagttcaggtgctgggcacagcggccctgggctgcctggtcaaggactacttccatctacactactgagcgggctggcaaggcgcatagnnnnnnnnnnn

SEQ ID NO: 280879 - DNA, 565 bp, Homo sapiens
  misc_feature: GYAE6OF01CJUUN.44.43.D10.1.454.CMB.1.raw
  modified_base (270)..(270): a, c, t, g, unknown or other
  misc_feature (270)..(270): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatgganctgagcagcctgagatctgaggacacggccgtgtattactgtgcgagatcccgaaagtatagcagctcggtcggggaggtggttcgacccgtggggccagggaaccctggtcgaccgtctcctcagcttccaccgaacgggcccacgtccggtccttcccccgtcggccgccctgcctccgacggacgccgaccctcgtcggggccacgacgccggcccgtcgggcctcggcccgtcggtcgaacggtaccctaccgttacccgaccgttcctaacgtcgcgtcgaggtccgggg

SEQ ID NO: 280880 - DNA, 530 bp, Homo sapiens
  misc_feature: GYAE6OF01A8P9L.44.43.D10.1.454.CMB.1.raw
tcagacagtatatacacgaccggtgctcgatttagactagcagtaagggggaactgatcagttaggacccagagggaaccatggaagccccagctcagcttctcttcctcctgctactctggctcccagataccaccggagagattgtgttgacgcagtctccagccaccctgtctttgtctccaggggaaagagccaccctctcctgcagggccagtcagagtgttagcagctacttagcctggtaccaacagaaacctggccaggctcccaggctcctcatctatggtgcatccaacagggccactggcatcccagccaggttcagtggcagtggtctgggacagcttcactctcaccatcagcagcctagagcctagaagtattttgctagtttatgtactgtcagcagcgtagcaacgtggaccgatccgaccgttcggaccctaagggaccacggacgtaggaacgtaacgttaaacggaacgttaggtaggctacgaccaccgtatctagttcttcgcttcccg

SEQ ID NO: 280881 - DNA, 674 bp, Homo sapiens
  misc_feature: GYAE6OF01AX62Q.44.43.D10.1.454.CMB.1.raw
  modified_base (193)..(193): a, c, t, g, unknown or other
  misc_feature (193)..(193): n is a, c, g, or t
  modified_base (302)..(302): a, c, t, g, unknown or other
  misc_feature (302)..(302): n is a, c, g, or t
  modified_base (454)..(454): a, c, t, g, unknown or other
  misc_feature (454)..(454): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccgaggggaangcccaccctctcctgcagggccagtcagagtgtagcagctacttagcctggtaaccaacacgtaaaccgtggaccaggcctcccgaggtcctcctcattctagtggtcncactccaacgcggaccagtcggactactcccgagccgtaggttcaggtcggcgtaggtcggtcgtagggactacgtaccttccgaccttcgtaccaaccgtataccgaacgcctacgtacccgtaaggacgtacccgttaaggtaacggttnttttacggacctttaaggtttactacggtaccttggttaccaacggtaccgacggtaccggttaacgaccgtaacgttccgggaccttaacgtcccgtacccggttacgggacccgaacgggtaccacggtaacgtaggtaaacgtaaacgttaacggacgttggacgtctaccggacctaaccgtacgttaccgttattacccttgtcccgttaccccg

SEQ ID NO: 280882 - DNA, 653 bp, Homo sapiens
  misc_feature: GYAE6OF01COHN9.44.43.D10.1.454.CMB.1.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggacacctcataaacacagcctacatggagctgagcagcctgagatctgaggacacggccgtgtattactgtgcgagatacccgaaagtatagcagctcggtcggggaggttcggttccggaccccgtcgggggcccgacggggaaccccgttcgggtaccgacccgttcctcccgtccgacgtcccttacccgaacccgaacgggtccccacgtaccgtaacgttccccgtttaccccccgtccgggtcccgtccccgtcgtcccgttcccgacgggaccgcccgtacccgtccggtcgggggccaccgacggcccggcccgtcgggccgtcggcccgttacgggtaccgtaaacggtacccttacccgtttaccctaacttacgttaccgttcggtccgttggtacccgggg

SEQ ID NO: 280883 - DNA, 626 bp, Homo sapiens
  misc_feature: GYAE6OF01CKJTH.44.43.D10.1.454.CMB.1.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccgaggggaaanacgccaccctctcctgcagggccagtcagagtgttagcagctacttagcctggtaccagcagaacgcctggccaggcctccaggcctccncatatacgatgcatccagcaacggcccgntggccagtccccagacgtaggttcaggtggctagggtgggactgggaccagtacttcactctcagcagtcgaggcggtactggganccgtaggagtacttcgagtcttaagtttactacgtgttcgagtcgtagtagttggttcggtctaacccgtgtacggtacggttacccggacggtaaacgggtaaccggtaagggtaacgtaaaacctaccggaaaaccggtaaggttccggtaaagaaccccggttacgaaccccgtaaacccgtttaacgttacccgtttacggttaccgttaaccttaaccccgg

SEQ ID NO: 280884 - DNA, 520 bp, Homo sapiens
  misc_feature: GYAE6OF01DGZ08.44.43.D10.1.454.CMB.1.raw
  modified_base (193)..(193): a, c, t, g, unknown or other
  misc_feature (193)..(193): n is a, c, g, or t
  modified_base (298)..(298): a, c, t, g, unknown or other
  misc_feature (298)..(298): n is a, c, g, or t
  modified_base (408)..(408): a, c, t, g, unknown or other
  misc_feature (408)..(408): n is a, c, g, or t
  modified_base (513)..(513): a, c, t, g, unknown or other
  misc_feature (513)..(513): n is a, c, g, or t
tcagacagtatatacacgaccggtgctcgatttagactagcagtaagggggaactgctcagttaggacccagagggaaccatggaagccccagcgcagcttctcttcctcctgctactctggctcccagataccactggagaaatagtgatgacgcggtctccagccaccctgtctttgtctcaggggaaagngccaccctctcctgcagggccagtcagagtgttagcagctacttagcctggtaccaacagaaacctggccaggctccaggctcctcatctatggtgcatccaacngggccactggcatcccagccaggttcagtgcagtggtctgggacagacttcactctcaccatcagcagcctagacgcctgaagtattttgctagtttatgtactgttacngcagcgtacgcaacgtggccatcctaccgttcggaccgtaagggaccacgacgtggaagtaagttaaacgaacttggtaggcctgaccaccgtatcttgtcttcnttccccg

SEQ ID NO: 280885 - DNA, 579 bp, Homo sapiens
  misc_feature: GYAE6OF01CLTMC.44.43.D10.1.454.CMB.1.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggacacctcataaacacagcctacatggagctgagcagcctgagatctggagacacggccgtgtacttactgtgcgagactcctagaaagtatagcagctcggtcggggaggtcggttcgaccccgtggggccagggaccctggtcctaccgtcctccgtcacgcttccgaaccgacgggcccaagtcccgggttaccttccccccgtggcccgtcccgtcgccttccgacggacgacctacccgttcggtcgggggtccacgacggcccggcccgtcgggctcgccgtggtacgaacgtaccgttacttacccgacgttacgtactcgcgtggtacggg

SEQ ID NO: 280886 - DNA, 553 bp, Homo sapiens
  misc_feature: GYAE6OF01D653A.44.43.D10.1.454.CMB.1.raw
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (548)..(548): a, c, t, g, unknown or other
  misc_feature (548)..(548): n is a, c, g, or t
tcagacagtatatacacgaccggtgctcgatttagactagcagtaagggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctnatctatgatacttntagtcgggcctcgtggcactcccagcccgtnttcagtgcaggtgggtctgggacngcttcactctcacatcaccngcctagacncctagaatatttgcttagtttattactgtactaacgaaccgtaagacgtcggtcctactaattcttctacgtttccggccgtagggaacctaaaggtggtatactacgaaacgtactggtacgctgccacgtatcttgtcttacacttccctccccgtacattcctagtnttaac

SEQ ID NO: 280887 - DNA, 658 bp, Homo sapiens
  misc_feature: GYAE6OF01BUDH5.44.43.D10.1.454.CMB.1.raw
  modified_base (286)..(286): a, c, t, g, unknown or other
  misc_feature (286)..(286): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaaccacctcaataaacacagcctacatggagctgagcagcctganatctgaggacacggccgtgtattactgtgcgagactacccgaaagtatagcagtctcggtcggggaggtcggttccgaccccgttggggcccagggaacccgttggtccgaccgttcctcctcgacgcttccgacccgaacgggtcccacgtccggtcccttcccccgtcggtcccgtccccgtcgccttcccgaacggtcgcccgtacccgttccggtcgggggacctaccggtacggcccgggtacccgtcgggtccgtccggtcccggttacgggttacccggaaaccgggtcccgttaacccgtttcccccggtaacccggttaccgttaacccggttcggaccgttcggggaaccggtcccgggggg

SEQ ID NO: 280888 - DNA, 565 bp, Homo sapiens
  misc_feature: GYAE6OF01CTDPS.44.43.D10.1.454.CMB.1.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (336)..(336): a, c, t, g, unknown or other
  misc_feature (336)..(336): n is a, c, g, or t
  modified_base (379)..(379): a, c, t, g, unknown or other
  misc_feature (379)..(379): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccgaccggggaattgtgttgacacaatcctccagccacctgtctttgctcgaggggaaangccaccctctcctgcacgggccagtcagagtgtagacttatgctgtancaangacnctggcagctccagctcnatctangatgcatccgaagtagggccgcggcactcccgagcctaggttcagtggacaggtggtctgagacngacttcactcacaccatcgacggccgcagaggaccggtaagtntttagactagtttattacgtgtacaacctacgtagccgtaacgtggtaccgttaacggtacgtagggttttcgggaccgacggggtaacctaagggtcgtagggacgaccgtacgaaaacggtacgtaggtcggcgtgaccgtactacgttctcgttacttcacgttcccttccgacctagtctag

SEQ ID NO: 280889 - DNA, 582 bp, Homo sapiens
  misc_feature: GYAE6OF01BAPRA.44.43.D10.1.454.CMB.1.raw
  modified_base (187)..(187): a, c, t, g, unknown or other
  misc_feature (187)..(187): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggtcgaccccgtggggcccagggaccctggtcaccgtctcctcacgcttccaccaacggcccatccggttccttcccccgtcggccgcccctcgcctcccgacggtacgcccacccgtaccgtcgggggtccacgacggccggcccgtcggggtccgtcggcccgtcggtccgaaacgggtccttaaccgttcccttaacttacttaccttaggttcctggtaggtccgggg

SEQ ID NO: 280890 - DNA, 668 bp, Homo sapiens
  misc_feature: GYAE6OF01DVPO9.44.43.D10.1.454.CMB.1.raw
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacacagtctccaggcaccctgtctttgtctccgaggggagagagcccaccctctcctggtacgggccagtcggagtgttgactaagtacctagcctggtaaccaacacgaaacctggaccaggcctacccgaggtcctcctcactctatgatcgactactaccgaaggtacggggccgcgggacaccgtcccgagccgtaggtttcgaggttcggacgtagggtcgggtactaggaacgtacacgtaccttcactctaccactacgtcgacggccggactaggacggacggtaagtacgttttcgactttagtttaacttacgtagtaccaacggtaccgtagccgtacgtcggtaccgttaaggtacgttacggtttcgggaaccggacggggtacaacggtcgtacggtaacgaccgttaaccgaaacgtaggtcggtcgaccgtaccgtaccaacttcgttcgttcgttaacttcctaccgttccccttaccccgtcgtacttccgttaaacg

SEQ ID NO: 280891 - DNA, 818 bp, Homo sapiens
  misc_feature: GYAE6OF01ESVTI.44.43.D10.1.454.CMB.1.raw
  modified_base (196)..(196): a, c, t, g, unknown or other
  misc_feature (196)..(196): n is a, c, g, or t
  modified_base (326)..(326): a, c, t, g, unknown or other
  misc_feature (326)..(326): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccgaccggagaaatagtgatgacgcggtctccagccaccctgtctgtgtctccgaagggggaanacgcccaccctctccgtgcgacgggccagtcgagtagttgttacgcagacctaaacttcgcctacgtacagactaagaactcgtaggccgacggcctacccgagtcctactacgtactctagtcggtacncgtaacctccggtaccgacggtaccctagtcggtacctccgacgccgtacggttacgacgggttagcggtacggttggggttaccgagggtaacgtaacgggtacttacccgtaccttactaacccgaacctacgtacctacgggaccacgtaccggcgttacgtacgggtacttaacggtaatttacgtttcggacttttaaaggttttacgtacgttcgtactaacggtattaaagttaacgttatacccgggacgtttacccccggtccccgttaaccccggggggttaaccaacccgggggttaaaaggtccccgttaaaaacggggttaccggtaaacggggttaaaccggttttaaaaacccggtaaacggggtttaaccgttcgggggtacccggttaaccgtacccggaaccccgttaaccgtttacggtttacccgtcggttttaaacccctttacgttcccccggttaaaccccttacccgg

SEQ ID NO: 280892 - DNA, 840 bp, Homo sapiens
  misc_feature: GYAE6OF01DW83W.44.43.D10.1.454.CMB.1.raw
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaacgtgggtgcgacaggccacgtggacaagggcttgagtggatgggatggatacgaaccctaagagtacggtaacacgaggctatcgaccaacgagtaacgttccgagggcagacgtcaccancgaccgaaggaaccacctaccaataaaccacgacgacctacagtggacncgtaganccgacgtccgtagacgtacgttacggacggaacggaccgaccgggtccgttagttaacgtttacgtggacgacggtaacgtaaccgtaaccggtaaagttacgacggccgtaacggtccggttaccgggggttacgggggtacggttcccgggtaccccggtacccccggggttcggggaacccggtaaccgggtaaccccgttgggtaaccccctaccggttccctacccgtcgaaccgttccccgttacccgaaacccggtaccggtccccttaccggtttccccgggttcccccttcccccggcgggtccccgtaaccccgtcgtacccgtaccgggcggtaacccacccggttaacccgggttggggacccggggaaccctaccgggtcccggggcccgggttccccggaggggttccccgttaccgggtacccgtaccgggttaaccgaaaccggtttccctttaaccggtttaaactacggtttaacccgttcgttaccgggtacgttcgggaacgggttccccgggg

SEQ ID NO: 280893 - DNA, 646 bp, Homo sapiens
  misc_feature: GYAE6OF01ARP1U.44.43.D10.1.454.CMB.1.raw
  modified_base (194)..(194): a, c, t, g, unknown or other
  misc_feature (194)..(194): n is a, c, g, or t
  modified_base (327)..(327): a, c, t, g, unknown or other
  misc_feature (327)..(327): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccgaggggaaanagccaccctctcctgcagggccagtcagagtgttagcagctacttagcctggtaaccaacagaaacctggccaggcctcccgaggcctcctcatctagtcggtgcactccaaccgagggcccacgtggtaccncccgagcctaggttcaggtggctacggtcgggtacgtcggggaactaggtacgttccaacttcctacaaccctatccgacgcacgtccctgaccgtacgtctaggtaaacgttgttttacgaccgttaagttttaacttacgtcgttacaacggtctaagttaactaagtcgtaacgtcggtacccttccgtacggtaccgaagggtacctacggtaacgtaggaacgtaacgttaaaccggtacttaggtaacggtccgtagaccctaactaccgttcttcgttaccttacgttacccttcccttcccgtaacttacg

SEQ ID NO: 280894 - DNA, 656 bp, Homo sapiens
  misc_feature: GYAE6OF01C38ZU.44.43.D10.1.454.CMB.1.raw
tcagacagtatatacacgaccggtgctcgatttagactagcagtaagggggaactgctcagttaggacccagagggaaccatggaagcccagctcagcttctcttcctcctgctactctggcctcccagataccaccggagagattgtgttgacacagtctccaggccacctgtctttgtctcgagggagagacgccacctctccgtggtacgggccaggtcggagtgttgactaagtacctagccgtcggtaccaacgaagaaaccgtcggaccaacggcctacccgaggtcctcctacattactatacgagtcgacataccgaacgtaggtcacgtcggaccaaccccgagacgtaggttcgagcggactaggtcggtacgtgggacagtactcgactcacactactcaaccgacgaccgtagacgtacctagtaacgtagtttacgacgttaagtttaacttacgttacgtacctaacgtacgtaagtaacggtcgacctactaattacttccgtacgtttccggaccgttacggaacgtaagtacggtaacttaacgtaacgaaacgtacttaggcgtactacggacctaacgtacttacgttacgttccttacgttaccgtacccgttacccgtacctcgttacgttaacg

SEQ ID NO: 280895 - DNA, 754 bp, Homo sapiens
  misc_feature: GYAE6OF01C1T56.44.43.D10.1.454.CMB.1.raw
tcagacagtatatacacgaccggtgctcgatttagactagcagtaaggggctgaggtgaagaagcctggggcctcagtgaaggtctcctgcaaggcttctggatacaccttcaccaattatgatatcaacgtgggtgcgacaggccactggacaagggcttgagtggagtgggatggatagaaccctaagagtaggtaacacgaggctatcgacacagtaacgttccgagggcagacgtcaccatacgaccgaggaaccacctaccaactaaacacacgacctacagtaggacgcgtagagcgaacgtccgtagacgtagtcgtaggacgggaacccgtacgggtaccgttgttaacttacgtaggtcggacgacgtaccgtaaccggtaagtacgtacgcgacggtaccggttcgggtacggggtacggttccgggttacccggtaccccgggtcggggacccggtacggggtaccccgtcgggttacccgtacccgttccgtccgtaccgtacgtaccccgttacccgaaccggaccgggtccctacggttcccgttccccttccccggtcggcccgtcccgtcgtccaccggtagacccgaccgtacccggtcgacgaccggaccgtaccggccgggtcccggtccggtcgggtccgttccggtccggttacgtaaccggtaaaccggttacccgtttacccgtacccggtacggtacccgtccggttccggttcggcggtaccccggggg

SEQ ID NO: 280896 - DNA, 834 bp, Homo sapiens
  misc_feature: GYAE6OF01EACBJ.44.43.D10.1.454.CMB.1.raw
  modified_base (195)..(195): a, c, t, g, unknown or other
  misc_feature (195)..(195): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgttctttgtctccgaggggaaancgccaccctctcctaggtacgggccaggtcggagttgttgacttaacgtacctagccttacggtaaccaacgacgtaaaccgtcgggaccaacggcctcccgacggtccttccctactacttacctatgtaactgaccacttacccaagtacggggtccaacgtcggacccaacccgagtacgtaggttcaggtggacgtagggtcggtcgtacggggacacgttacttaccgtaccttaccgtaccgtaacccggttacaacgtacgtaagttacggaaccgtacggtaccgtaaggttaagtttacgttttcggtaacctttaggtttttaaacgtttacccgttaggttaaccgtacgtacccggttcggttcccgttttaaccccggaccgtaccgggtacccgttcgtttaccccgggttaccggggtttacccggggggaaaccggggggttaaccgtaagggggtccggaaacggttaccgttaaccgggaaacggtaacccggttaacggttcgggttaccgggttacctaccgggttaaccccgtacgttaaccgtttccggttacggtttccccttaacggttacccgtttcccctaacccggtacttaccgtttaccgtagttaaacg

SEQ ID NO: 280897 - DNA, 813 bp, Homo sapiens
  misc_feature: GYAE6OF01CTAGX.44.43.D10.1.454.CMB.1.raw
  modified_base (197)..(197): a, c, t, g, unknown or other
  misc_feature (197)..(197): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtcctccagcccaccctgtctttgtctaccgaggggaaancgcccaccctctcctggcgacgggccagtacagagttgttagcagcttacttacgcctacggtaccaacaacgaaaccgtcggaccgaacggtcctcccgaacggtcccttaccctctaacgttccttaagttcggggtcacctaaccgttaccgaaacgtaccggggaccctacgtcggaccctaaccgtaccccgaaggtcccgtaacggtttacgacgggttacgggcgttacggggtcgggttacgtacggggtaacgtaacggttaccctttaccgtaccgtacccttacccgaaacctacgtaccgaccgtcgtaaccgaccgttaacgggacttcccgttaaggtaacgtttactttaacggctttaagtttaacgtcggtacgttacgtacgaccgtacgtacggtaccgtaacgtacccgtaacggtccggtaacccgtactacccgggttaaccggttacccggggaacccgtaaggtccccggtaaccggtaaggtacggtaaaccgttaaacggttaaaccggaacgggtttggacgtaaccgtcccgaacggtaacccttaccgtttacggttccctttacgtaacccgtccgtttaccccgg

SEQ ID NO: 280898 - DNA, 776 bp, Homo sapiens
  misc_feature: GYAE6OF01A0NX3.44.43.D10.1.454.CMB.1.raw
  modified_base (255)..(255): a, c, t, g, unknown or other
  misc_feature (255)..(255): n is a, c, g, or t
  modified_base (739)..(739): a, c, t, g, unknown or other
  misc_feature (739)..(739): n is a, c, g, or t
tcagacagtatatacacgaccggtgctcgatttagactagcagtaagggggaactgctcagttaggacccagagggaaccatggaagccccagctcagcttctcttcctctgctactctggctcccagactaccaccggggaaattgtgttgacacaatcgtccagccaccctgtcttgtccgtaccggggaacgcgccaccgtctcgtgcacgggtccgaccagctgtgacgacgtacttagcctagtaccaanagacgcgtggccacggtcctccagtacctccgtactatcttactagtacttaacttccgtaagtacggtccctagtcggtacctacgtcccgacgcccgtacgttcgaggtacggtccgaggttcgggtaccgtgggtaaccgacgtacttaccgaccttacgtacccaacctacggttaccaaccgtacggtacctaggaccgtacgtaggtaacggttatttaccggacttacgttttaactacgttaccgttaaacttaccggtaaccggttaaaaggccgtttaccgtaccttaacgttaactttacgttaccttaacccggtttaccggacccgggttaaggtaaaccgtaacgggttacggtaactttaaacccgacgttaaaacccgggttactacgggggttacgtccgttacggccccttaagttaaccgttccgttacggtttccttaccggtaaccctttcccgtttaacccnccgtttaacgtacttacgggtaacttaaacgttcccg

SEQ ID NO: 280899 - DNA, 862 bp, Homo sapiens
  misc_feature: GYAE6OF01A2K6H.44.43.D10.1.454.CMB.1.raw
  modified_base (195)..(195): a, c, t, g, unknown or other
  misc_feature (195)..(195): n is a, c, g, or t
tcagacagtatatacacgaccggtgctcgatttagactagcagtaagggggaactgctcagttaggacccagagggaaccatggaagccccagctcagcttctcttcctcctgctactctggctccagataccgaccggagagattgtgttgacgcagtctccagccctacctgttctttgctccgaagggaacncgcccacctctccgtgcggacggcctagtcgtaggacgttagttagacgtacgaccgttacgttacgaccgttacgggaaaccctaaacgtaacggaaaccgtcgggacccgacgggcccttacccggacggaccctttacccgtacgttaacggtaccttaaggtcggggttaccaccgtaactaaccccggaaacgtaccgggaacccgtacgtaccggacctaccggtacccgacgacccgttaaggttccgaagggttacggaccggtagggttcggaaggttaggggaactacggtacctttaccaacgttccgtaaccaacgtacgtacgaacggtacaccggttaaccgacgtaccggtccgtaaggtaacgtttacggttacgtacggtttaagttaagtaccggttattcggtaaccgacgtaacggtaccacgggttaaccgtaacggtacggttaacccggtaccgttaaccgtacccgggttaacccggttaacggtaacccgggtaaccggaaccggttaaccgggaaccggttaacggtaaacgttaaaaccgttaaaccccggttaggttaacgggaccggttacgttaacccgaccttaaccggtacgtttacccgttaaggtttacccctcgttaacccgtttaccccgg

SEQ ID NO: 280900 - DNA, 1002 bp, Homo sapiens
  misc_feature: GYAE6OF01AYR8W.44.43.D10.1.454.CMB.1.raw
  modified_base (762)..(762): a, c, t, g, unknown or other
  misc_feature (762)..(762): n is a, c, g, or t
  modified_base (979)..(979): a, c, t, g, unknown or other
  misc_feature (979)..(979): n is a, c, g, or t
tcagacagtatatacacgaccggtgctcgatttagactagcagtaagggctgaggtgaagaagccgtgggcctcagtgaaggtctcctgcaaggcttctggatacaccttcaacctaattatgatatcgaacgtgggtgcgacgaggcctaacgtggaccaagggcttgagtggagtgggtagaatcgtactttcccgttgtttttacggccttacctaccttccgtaacccgttacggcgaaccggtacggtaccggtttccgggggactaacgggtaactttaccggaacgtttaacccgggccggtaacgtaaccgttcccgaacgtaaaccggtaacctaacccgttaacggttcccctaaccgtaacggttacggtaaaccctaaagtttaccgggttacgtttttaccgttttaaacggaaaaccgttccccggtaaaaccggtaaccccgttaaccggggtaccccgtttaccgttaaacccgttaccgttacggtccggtaacggtaacccggttaccggggttacccccgttaccccgacggtcccgtacggtaccgtacggttacgggtacccgtaccgttttacgggacgtaccggttcggggtaccgggggaacctaacccggggtacccggtttagtaaccgtttcgttaaccgtaccgtaccgttacccggtacgttacccgtaacccggtaacccggtaccgggtacccctttaggtttaccccggttccccgttttacccccgggnggttcccccgtacccggtttggtccccgttacccggacggtaccccgtacggttccccggtttaaccggggccggtacccggtaacgccccgggggttcccgtcccggttcgggacccttcgggaaaccgttcgggtaaccgtaaccgttaccggttacccgttacgttaacttaccgttcggccggtttacgaccggggttccgacgggtttaccnccggggttactaacggggtaccc

SEQ ID NO: 280901 - DNA, 208 bp, Homo sapiens
  misc_feature: GYAE6OF02IFKVK.44.43.D10.1.454.CMB.1.raw
  modified_base (207)..(208): a, c, t, g, unknown or other
  misc_feature (207)..(208): n is a, c, g, or t
tcagacagtatatacacgaccggtgctcgatttagactagcagtaaggggaactgctcagttaggacccagagggaaccatggaagccccagctcagcttctcttcctcctgctactctggctcccaggaactgtggctgcaccatctgtcttcatcttcccgccatctgatatatactgtctgagcgggctggcaaggcgcatagnn

SEQ ID NO: 280902 - DNA, 536 bp, Homo sapiens
  misc_feature: GYAE6OF02IO8LF.44.43.D10.1.454.CMB.1.raw
  modified_base (343)..(343): a, c, t, g, unknown or other
  misc_feature (343)..(343): n is a, c, g, or t
  modified_base (450)..(450): a, c, t, g, unknown or other
  misc_feature (450)..(450): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccccaggtacagtctacatggaactgagcagcctgagatctgaggacacggccgtgtatttctgtgcgagagccacagcacctggcttgacttgngggccagggaccctggtcaccgtctcctcacgcctccaccaacgggcccatccggtccttcccccgtggccgccctgcctccgaggacgccacctccgagacgcacngccggccctgggcctggcctggtcaacggtacctactttcccgacgtactccgcgttccgtggacggccgggctcgggcgaacggg

SEQ ID NO: 280903 - DNA, 517 bp, Homo sapiens
  misc_feature: GYAE6OF02G2VB4.44.43.D10.1.454.CMB.1.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggcccagggaaccctggtcaccgtctcctcagcttccaccaagggcccatccggtcttccccctggccgccctgcctccaggagcacctctggggcacgcgcggccctgggctgcctggtcaaggctacttcctatactactgtctgagcggg

SEQ ID NO: 280904 - DNA, 551 bp, Homo sapiens
  misc_feature: GYAE6OF02HG7XY.44.43.D10.1.454.CMB.1.raw
  modified_base (364)..(364): a, c, t, g, unknown or other
  misc_feature (364)..(364): n is a, c, g, or t
tcagacagtatatacacgaccggtgctcgatttagactagcagtaagggggaactgctcagttaggacccagagggaaccatggaagcccagctcagcttctcttcctcctgctactctggctcccagataccaccggagagattgtgttgacgcagtctccagccaccctgtctttgtctccgggggaacgagccaccctctcttgcagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccgtnagcaatgtacagcctagaagtatttgctagtttattactgtcagcagtcgttcctccacggtccgtctctaccgtttccgggccgggggtaccgaagggtcgggagacgttcgaaggacgaacgtggtcggcgtgccgaccgacttccgtgttccttcgtacttccgttcccgccctacttctgtac

SEQ ID NO: 280905 - DNA, 511 bp, Homo sapiens
  misc_feature: GYAE6OF02IPZQO.44.43.D10.1.454.CMB.1.raw
  modified_base (418)..(418): a, c, t, g, unknown or other
  misc_feature (418)..(418): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaaagagccaccctctcctgcagggccagtcagagtgttagcagctacttagcctggtaccacagaaacctggccaggctcccaggctcctcatctatggtgcatccaacagggccactggcatcccagccaggttcagtggcaggtggtctggggacagacttcactctcaccatcagcagcctagagcctgaaagtattttgctagtttatgactgtcagcagcgtancaactggaccatcaccgttcgaccaagggtacacgacgtggacgtagttaaacgaactggtacggtacctgacaccattcctagtcttcattc

SEQ ID NO: 280906 - DNA, 569 bp, Homo sapiens
  misc_feature: GYAE6OF02HKU1V.44.43.D10.1.454.CMB.1.raw
  modified_base (310)..(310): a, c, t, g, unknown or other
  misc_feature (310)..(310): n is a, c, g, or t
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattacngtgcaagagccggtgcggggagttcggggagttgcatactactactacggtatggacgtcgtggggccaagggaccacggtcaccgtctcctcagcttccaccaacggcccataccggtcttccccctcggtccgcccgtcgcctccgacggacgccgaccgtccgtcgggggaccaccgacggccggccccgtcggggccgtcggcccgtcgggtacccgaacggtaccttaccgttcccgacggttcctacgtccgg

SEQ ID NO: 280907 - DNA, 545 bp, Homo sapiens
  misc_feature: GYAE6OF02IA7A2.44.43.D10.1.454.CMB.1.raw
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaaagagccaccctctcctgcagggccagtcagagtgttagcagctacttagcctggtaccaacagaaacctggccaggctcccaggctcctcatctatggtgcatccaacagggccactggtatcccagccagattcagtggcactgggtctgggacaggagttcactctcaccatcagcagcctgcagcctggagtactttcgcgtactttattactgaccaactaattacttacttttttatccgttatacgttttaggccgtaaggggtacctaaggtcgtaggacgtatacgaaaggtacttggtacgctagcaacctagttacctcgtacttccacttccgttcccgctac

SEQ ID NO: 280908 - DNA, 584 bp, Homo sapiens
  misc_feature: GYAE6OF02IZW5Z.44.43.D10.1.454.CMB.1.raw
  modified_base (292)..(292): a, c, t, g, unknown or other
  misc_feature (292)..(292): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaaagagccaccctctcctgcagggccagtcagagtgttagcagctacttagcctggtaccaacagaaacctggccaggctcccaggcctcctcatctatggtncatccaacagggccactggcatcccagccaggttcagtggcaggtggtctggggacaggagttcactctcaccatcagcagcctgcagtctgaagtatttgactagtttattactgtcagtcagtataagtcgtactcggtacccttcccgttccggaccgtaaacgggacctaacggaacgttagggaacgttaacgtttaaaccggtaacgttaggtacggtacgtacggtacctaccgtaagttacctacggtttccctttacgtactttcccgtttaccccggtaccc

SEQ ID NO: 280909 - DNA, 514 bp, Homo sapiens
  misc_feature: GYAE6OF02JA22J.44.43.D10.1.454.CMB.1.raw
  modified_base (381)..(381): a, c, t, g, unknown or other
  misc_feature (381)..(381): n is a, c, g, or t
  modified_base (470)..(470): a, c, t, g, unknown or other
  misc_feature (470)..(470): n is a, c, g, or t
  modified_base (483)..(483): a, c, t, g, unknown or other
  misc_feature (483)..(483): n is a, c, g, or t
  modified_base (499)..(499): a, c, t, g, unknown or other
  misc_feature (499)..(499): n is a, c, g, or t
tcagacagtatatacacgaccggtgctcgatttagactagcagtaagggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagccctggtaccaacagaagcctggccaggctcccagactcctcatctatgattacttctagtagggcctctggcatcccagccccgcttcagtggcaggtgggtctgggacagacttcactctcaccatcacagccctagacncctgagtatttgctagtttattactgtctactacgtagaagtgctcaatattcactttcgcctggaccaagtgatatacaaacgactgngctgcaccatctntccttcattccttccncctactctgtattac

SEQ ID NO: 280910 - DNA, 571 bp, Homo sapiens
  misc_feature: GYAE6OF02H882V.44.43.D10.1.454.CMB.1.raw
  modified_base (193)..(193): a, c, t, g, unknown or other
  misc_feature (193)..(193): n is a, c, g, or t
  modified_base (290)..(290): a, c, t, g, unknown or other
  misc_feature (290)..(290): n is a, c, g, or t
  modified_base (387)..(387): a, c, t, g, unknown or other
  misc_feature (387)..(387): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaaangccaccctctcctgcagggccagtcagagtgttagcagctacttagcctggtaaccaacagaaacctggccaggctccaggctcctcatctatggtncatccaacaggggccactggcactcccagccaggttcagtggcaggtggtctgggacagacttcactctcacatcagcagctagacgcctgaacgtnttttagctagtttatggacttgtacagcaggcgtaagcaacgtggacccgactccgtaccgttccggaccgaaacggggacaacgtacgtagggtacggtaatttaaaaccggaacttaggtacggccgttacgacccgtaacccgtactttccgttacggtttcctttaccgactttaccccg

SEQ ID NO: 280911 - DNA, 519 bp, Homo sapiens
  misc_feature: GYAE6OF02GI3G4.44.43.D10.1.454.CMB.1.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (498)..(498): a, c, t, g, unknown or other
  misc_feature (498)..(498): n is a, c, g, or t
tcagacagtatatacacgaccggtgctcgatttagactagcagtaagggggaactgctcagttaggacccagagggaaccatggaagccccagcgcagcttctcttcctcctgctactctggctcccagataccactggagaaatagtgatgacgcggtctccagccaccctgtctttgtctccaggggaaagagccaccctctcctgcagggccagtcagagtgttagcagctacttagcctggtaccaacagaaacctggccaggctcccaggctcctcatctatggtncatccaanagggccactggcatcccagccaggttcagtggcagtggtctggggacagacttcactctcaccatcagcagcctagacgcctgaagtatttgctagtttatgactgtcagcagcgtagcaacgtggccgatccgaccgttcggaccaacgggacacgactggacgtacgttaaacggaactggtacggctacgacaccnttccgtgtccttacattcccg

SEQ ID NO: 280912 - DNA, 581 bp, Homo sapiens
  misc_feature: GYAE6OF02G9Y80.44.43.D10.1.454.CMB.1.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgaccccgtggggccagggaaccctggtcaccgtctcctcacgcttccaccgaacgggcccacgtccggtccttccccctcggccgcccgtcgcctcccgacggacgcacccgtcgtcgggggccaccgacggccgggcccgtcggggccgtcggccggtcgggtccgaacgggtaccttaccgttcccgtaccgttccgtaccgttcgccgttaggcggtccgggg

SEQ ID NO: 280913 - DNA, 560 bp, Homo sapiens
  misc_feature: GYAE6OF02IXHQM.44.43.D10.1.454.CMB.1.raw
  modified_base (193)..(193): a, c, t, g, unknown or other
  misc_feature (193)..(193): n is a, c, g, or t
  modified_base (337)..(337): a, c, t, g, unknown or other
  misc_feature (337)..(337): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaaangccaccctctcctgcagggccagtcagagtgttagcagctacttagcctggtaccaacagaaacctggccaggcctcccaggcctcctcatctatggtgcatcccaacgagggccacgtggcactcccagccaggttcagtgcnggtggtctgggacagtacttcactctacacatcagccagcctagacgctgaagtatttgactagtttatgtactgtcagcagcgtacgactaacgtcggccgtatacctaccgttacggaccgaacgggaccaacggacgtagggacgtaacgttaaaccggtaacgttacggtaggccgttacgacctaccgtactaccgttcgttaccttcgtacttcccg

SEQ ID NO: 280914 - DNA, 660 bp, Homo sapiens
  misc_feature: GYAE6OF02HFIY3.44.43.D10.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccacctgtctttgctccagggaancgccacctctccngcagggccagtcagagtgtagcagctactagcctggtaccaacagaaacctggaccaggcctcccgaggtcctcctnatctagtggtcncatccaagcgggccacgtggacctactcccagcctaaggttcaggtcggcctagggttcggtaccgtaggggaacctacggtactttaccgaccgttctaccgaaccctagtccgagtccaacggtccctaagacgtccctaaggtaacgtaacttttggacttaaggtttacgacggtaacttggtacctaagtacctaggtacgtacgaccgtaacgtacgggtacctacgtaccgtaaccgttccggaacgtaacgggactaaccgggagtacgggaacgtaaacgttaaaccggtaacgttggtaccggtaccgtacgacccgtaacgtacgttaccgttacgtacctttccgacctttaccccg

SEQ ID NO: 280915 - DNA, 750 bp, Homo sapiens
  misc_feature: GYAE6OF02J1Q79.44.43.D10.1.454.CMB.1.raw
  modified_base (189)..(189): a, c, t, g, unknown or other
  misc_feature (189)..(189): n is a, c, g, or t
  modified_base (299)..(299): a, c, t, g, unknown or other
  misc_feature (299)..(299): n is a, c, g, or t
  modified_base (675)..(675): a, c, t, g, unknown or other
  misc_feature (675)..(675): n is a, c, g, or t
tcagacagtatatacacgaccggtgctcgatttagactagcagtaaggggaacgtgctcagttaggacccagagggaaccatggaagcccagctcagcttctcttcctcctgctactctggctcccagactaccaccggagagattgtgttgacgcagtctccagccacctgtctttgctccagggaancgccaccctctcctgcgacgggccagtcagagtgttagcagctacttagcctggtaccaacagaaacctggaccaggctacccgaggcctccgtcattcctagtcggtcncctagtacccaaacgtacgggcccaacggttcgggacctacgtccccgtaaggtaccgtacgggtttccaaggttcgggacctaacgggttcgggtaccttagggggaactacggttaccgtttccaaccggttcaacccgtacccgaattccgaacggtcccgaaccgttacccgtaaggtaccgaccccgttaagtaacggttaacgtttttcgaccgttaaggtttacgtcgtaccgttgttaccgaggtaccgaacggtcgttagacccgttaaggtcccggaccgtaacgttacccgtaaccccggttcgggaacccgtaaacgggaccgtaacggtacccgtagggtaacgtaacgttttaaaacccggnggttacggtacgggtacctacgtaaccgtaccgtaccggtacgtttacggtaccctttaccgtagtttacccccg

SEQ ID NO: 280916 - DNA, 657 bp, Homo sapiens
  misc_feature: GYAE6OF02GXJMK.44.43.D10.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctcgaggggaaangccaccctctcctgcgagggccagtcagagtgtagcagctacttagcctggtaaccaanagaacctggccaggcctcccgagcctcctcatctagtggngacatccaacgcgggccacgtcggacactcccgagtcccgtaaggttccaggtcggctaggttgggtccgtaggggacctaggtacctttccgaaccgtttccacgaccctaatccgaacggtccaacggtcccgtaaggacgtaccgtaggtaaacgttagttttcgacgttaagtttagtacgtacttgtacacggcgacggtcgtaacgcgtaaccggtcggtacccgtacgttaccgtacccggttaccggaccgtaaaccgggacgtaaccgtacggtacggaacggtaacgttaaacggaacttcggtacggtacgtacgaccaccgttacgttccgttagtccgttacaccgttcccg

SEQ ID NO: 280917 - DNA, 682 bp, Homo sapiens
  misc_feature: GYAE6OF02HP8LO.44.43.D10.1.454.CMB.1.raw
  modified_base (193)..(193): a, c, t, g, unknown or other
  misc_feature (193)..(193): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccgaggggaanagccaccctctcctgcagggccagtcagagtgttagcagctactagcctggtaccaacagaaacctggaccaggcctccgaggcctcctcactctagttggcgctactaccgaacgacgggaccacgtcggaccactccccgagcccgtaggtttcaggttggactagggttcgggtcgtaggggactagtacctttacaccgttctaccgaacctattaccgagaccgacgtacccgtaagaccggtcccgttaagggtaaacgtttacgtttttacgaccgtttaaggttttatacggttaaccgttcggttaccgacggtaccgtacgggtacgttaacgaccgtaacggttcggaacccgtaccttcccgtaacccggttccgggaaccgtaaacgggtacaacggtacgtaggtaacgtaacgttaaccggagtcggtacggcgtacgaccacttacgttcgttcgttcttacctacttccccg

SEQ ID NO: 280918 - DNA, 598 bp, Homo sapiens
  misc_feature: GYAE6OF02I197K.44.43.D10.1.454.CMB.1.raw
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaacagccaccctctcttgcagggccgcagactgttgacgacgacttagcctggtaacccaacgagaacgcctggccaggcctcccagactcctcatctatgatgcatccaacgagggtcacgtggccacccagacagttcagtgcagtgggtctgggacagacttcactctcaccgtcagctaatcgtacagtcctagaacgtattttcggacttagttttatacttgtactagactagtccttccgtaccgaggtcccgtcgttccgtaccggtttcggggacccggggaacgtaaggggtggaacgtacgtacggacgacgtaacgttgggtacggtccgtcggcccgtaactcgttacgtcgttccttaccgtaccgttccccgttacccggtacctacgttaccg

SEQ ID NO: 280919 - DNA, 602 bp, Homo sapiens
  misc_feature: GYAE6OF02ISW38.44.43.D10.1.454.CMB.1.raw
  modified_base (187)..(187): a, c, t, g, unknown or other
  misc_feature (187)..(187): n is a, c, g, or t
  modified_base (288)..(288): a, c, t, g, unknown or other
  misc_feature (288)..(288): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccaggaacacctccataaacacagcctacatggagctgagcagcctgagatntgaggacacggccgtgtattactgtgcgagatcccgaaaagtatagcagctcggtcggggaggtggttccgaccccgtggggccacgggaaccctggtcacccgtctcctcgacgtccttccaccgaacggccctacgtccggttcccttccccgtcggccgtccccgtcgcctcccgaggacgaccgaccgtcggtcgggggccaccggacggaccgggtcccgtcgggtcctccggtccggtcggttaccgaaacggtaccttaccgttacccgtaccggttacctaccgtcggccgtggacggtaccgggg

SEQ ID NO: 280920 - DNA, 596 bp, Homo sapiens
  misc_feature: GYAE6OF02F1GF3.44.43.D10.1.454.CMB.1.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagactcccgaaagtatagcagctcggtcggggaggtggttccgacccgtggggccacgggaaccctggtccaccgtctcctcacgcttaccaccgaacgggccccagttccggtccttcccccgtcggccgccccgtcgcctccgacggacgccgtacccgtccgtcggggccacgacggccggcccgtggggtcctcggcccgttcgggtaccgaacgggtacccttaaccgtttaccctaagttacttaccgttcggtccgttcggaccggtccgggg

SEQ ID NO: 280921 - DNA, 892 bp, Homo sapiens
  misc_feature: GYAE6OF02HMJOO.44.43.D10.1.454.CMB.1.raw
  modified_base (194)..(194): a, c, t, g, unknown or other
  misc_feature (194)..(194): n is a, c, g, or t
tcagacagtatatacacgaccggtgctcgatttagactagcagtaagggggaactgctcagttaggacccagagggaaccatggaagccccagctcagcttctcttcctcctgctactctggctcccagactaccaccggagagattgtgttgacgcagtctccagccaccctgtctttgctccgaggggaaanacgccaccctctcctgcagggccagtcagagtgttagcagctacttagcctggtaccaacagaaacctggccaggcctcccgaggcctccctcgacttctaagtggtcgaccacgtacccaacgacggggccctaacgttcggacctaaccgttcccccgaagtccccgtaagggttttcccaaaggtttccggggacgtaacgggtttcggggttccgttaacgggggaacctaacggtacctttccaaccgtttccgtacccaacccgtaaacgttcccgaacgggttaccctaacgggaccccttaaacgggtaaccgtacccggtttaacggtaaaacggtttaaccggtttttttacggaacccgtttaaagggttttaaccgttaacggtaccgtttacggttacccgaacggtacccgtaacggttaccgggttaacgacccgttaaaacgggtttccgggaccccggttaaacgttaccccggttaacccggtttacccgggtaaccccggaaaacgggggtaacccgttaaaccgggtaccgggttaacggttaaccgggttaaaaccggttttaaaacccggaaaccggtttcgggtaaccgggtaacccgtaccggttaacccgaaccccgtttaacgggttaccctttaaccgggtttacctttaccgtaacccgttttaccccgg

SEQ ID NO: 280922 - DNA, 698 bp, Homo sapiens
  misc_feature: GYAE6OF02FQCDI.44.43.D10.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagcccaccctgtctttgtctccgaggggaaanagccaccctctcctgcagggccagtcagagtgtagcagctacttagcctggtaaccaanagaacctggccaggcctcccgaggtcctcctcactctagtcggtgcatccgaacgngggcccacgtggcactcccagcccgtaggttcaggtcggacgtagggttcgggtcgtaggggaaccaggtacctttccgtaccttccgtaccaaccctagttccgaacggtccaacggtcccgtaacggacggtcccgtaaggtaaacgtttagtttttacggaccgtttaaggtttaacgtacggtaaccgttcggttacacggtaccgtacggtacggtacgtaccgtaacgtcgggacccgtactacccgttaccggtacgggaacccgtaaacgggacccgtaacgtacgtacgggtaacgtaacggttaaaccggtaacgttaggtacggtaccgtacgacctaccgttacttaccgttacgtcctttaccgtacgttccccg

SEQ ID NO: 280923 - DNA, 584 bp, Homo sapiens
  misc_feature: GYAE6OF02GAZ8R.44.43.D10.1.454.CMB.1.raw
  modified_base (193)..(193): a, c, t, g, unknown or other
  misc_feature (193)..(193): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccaccctgtctttgtctccaggggaaangccacctctcctgcagggccagtcagagtgttagcagctacttagcctggtaccaacagaacctggccaggctcccaggctcctnatctagtggtncanccgaacgacgggccacgtggacactcccagtcctaggttcaggtcgcgtaggtcggtactgggactgtaccttcgactcgacacgtactcacgcacgctacgacgtccgtagtaacgttgtttagcgttacgtttatacgtacgttgtacagtctagtcgtacgctaacgtcggaccgtactcgtaccgtcggaccggaagtacccaacggtacgtaggtacgtaacgttaaaccggaggttacgtggtactcggacctaccgtgttccgtacttcgttacctacttccccg

SEQ ID NO: 280924 - DNA, 643 bp, Homo sapiens
  misc_feature: GYAE6OF02HU4PW.44.43.D10.1.454.CMB.1.raw
  modified_base (185)..(185): a, c, t, g, unknown or other
  misc_feature (185)..(185): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatggatggatgaaccctanagtgtaacacaggctatgcacagaagttcagggcagagtcaccatgaccaggaaccacctaccaataaaaccacaagcctacatggagcgtgacgcagccctaggagactcgtggaggaccaccgggccggttagttattacgtggtcgtcggaagtacgtaccgtaaaagtactagcagccgtcggtacggggaggtcggttccgaccccggtgggaccgaacgggtacccgtcgggtaccgaccgtccgttcctcgaccgtccttcccgaacccggaaccggcccgtactcccggttacccgtttccccgtcggcccgtcccgtcgcccgttacgacggacgccacccgtcggcgggccaccgcggaccggcccgtcggtccgtcggtccgtcggttaccgacggtacgttacccttacctacgttacgtacgttcgttcggtgtacggtcccggg

SEQ ID NO: 280925 - DNA, 679 bp, Homo sapiens
  misc_feature: GYAE6OF02JEV66.44.43.D10.1.454.CMB.1.raw
  modified_base (195)..(195): a, c, t, g, unknown or other
  misc_feature (195)..(195): n is a, c, g, or t
tcagacagtatatacacgaccggtgctcgatttagactagcagtaagggggaactgctcagttaggacccagagggaaccatggaagccccagctcagcttctcttcctcctgctactctggctcccagatacccaccggagagattgtgttgacgcagtctccagccacctgttcttgtctccgaaggggaaancgccaccctctctgcagggccagtcagagtgtagcagctactagcctagtaaccaagacgtaaccgtggcctaggcctcccaggtcttaccgcattctagttggcactaactccgaacggacggcccaacggttcggacctaacgtccccgtaacgtccccgtaagggttcaacggtttccggacgtaagggttcggggtaccgaaggggtacctaacggttacctttacgacctacctcccgtaactacctacggaacgtctaacggacccgagtacaccgtagtaacgttactttagacgtttaagttagtcgtacctaggttacacgtacgacggttacgtacaacggtaagtccgtaacgcgtaccgtaccgtacgaaccgtaacggacaccgggagtacggtacgtaaagttaaccgagttacgtcgggacctcggtacaccgttcgttaccgttcgttaccgtcttacccgtacccgg

SEQ ID NO: 280926 - DNA, 752 bp, Homo sapiens
  misc_feature: GYAE6OF02HG0HE.44.43.D10.1.454.CMB.1.raw
  modified_base (520)..(520): a, c, t, g, unknown or other
  misc_feature (520)..(520): n is a, c, g, or t
tcagacagtatatacacgaccggtgctcgatttagactagcagtaaggggcgtgaggtgaagaagcctgggcctcagtgaaggtctcctgcaaggcttctggatacaccttcaccaattatgatatcaacgtggtgcgacaggccactggacgaaggcttgagtggagtggagtggatcgaaccctaagagtaggtaacaccaggactaatcgacacgaagaacgttccgagggacagaagtaccaaccgaagtcgaaccgaaggaaccacccgtaccaaacgtaaaaccacacgacccttaacgaagtaggacgtacgagacgacacgaccgtgaaggacttcgaggtacgaccgacggtacccgaggttacttacgtgtcggacgaacggaactaacccggaaagttacgtagaccgtaacgtccgtacggggttcggggtaggttccggtttacccgggacccggtacggggacccggttaccggtaacccgggttcgtacccgacccgtttacccncccggttaccacggtaccctcccggaacccgtaccgggcccctcggtttaccccggttcccttccccgacgggtacccgccccgttgccccgtaccggagtacccaccgtcccgtagggcccgggtcaccggtccgcccgggtacgttcggccgccgggtaccgtacggaccgtaacgggtacccttaccttacgacgttaccgttaccgtggttaccgtcgaggtcccggg

SEQ ID NO: 280927 - DNA, 706 bp, Homo sapiens
  misc_feature: GYAE6OF02G1ZON.44.43.D10.1.454.CMB.1.raw
  modified_base (193)..(193): a, c, t, g, unknown or other
  misc_feature (193)..(193): n is a, c, g, or t
  modified_base (281)..(281): a, c, t, g, unknown or other
  misc_feature (281)..(281): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccgggaaattgtgttgacacaatctccagccaccctgtctttgtctccgaggggaaanagccaccctctcctgcagggccagtcagtagtgttaggaactacttagcctggtatcaacagacacctggccagcctccaggctcctnatctatcgatgcataccgaagtacggggccgcgggcactaccccgagcccgagggttccagggttcggccgtaggttcggggttcctgtaacgtaaccaggtaccttactaacctccgtaccaaccctaagtcccgaacggtccgggtaacccttagggaccggtacccgggtaaacgttacgttttacggtaacgttaacggttttactttaaccgttacgttaccaaccgtacccggttacggaccgtacgttacggtaccgttaacgggttacgttacgggttttacggaccggtaacggggaaccgtaagtcgttagggacgtactaaccgaaacgtacgtcggtaggtccgtacggacctaccgtacgttacgtcggtttaccttacgtacgttcccttacccggtacctacgtcttacg

SEQ ID NO: 280928 - DNA, 634 bp, Homo sapiens
  misc_feature: GYAE6OF02F8R1E.44.43.D10.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
tcagacagtatatacacgaccggtgctcgatttagactagcagtaagggggaactgctcagttaggacccagagggaaccatggaagccccagctcagcttctcttcctcctgctactctggctcccagataccaccggagagattgtgttgacgcagtctccagccacccttgtctttgtctccgaggggaaancgccaccctctcctgcagggccagtcagagtgtagcagctattagcctggtaccaanagaaccgtgccaggcctcccgaggtcctcctacattcctagtcggtncctatcccaacggacgggtcccacgttggacctactccccgagaccctaggttcgaggtggcaggttcggtctagggactagaccttcactctcaacctncgacncaacgcctacgacgctagagttatttgacgttagtttanacgtcgtgttaccagtaccaggtccgagtacctaacgtccggactacgtcccgtacggttacccggaccgtaaacgggacctaaccgggtagtacggtaacgtaacgtaaaccgtacgggttcggtaacggtaccgttcgaaccctaaccgttacgttaccttacggttccttaccctacgtttacccccg

SEQ ID NO: 280929 - DNA, 592 bp, Homo sapiens
  misc_feature: GYAE6OF02GH0IY.44.43.D10.1.454.CMB.1.raw
  modified_base (587)..(587): a, c, t, g, unknown or other
  misc_feature (587)..(587): n is a, c, g, or t
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtacaccatgaccaggaaccacctaccaataaacacagcctacatggagctgagcagcctagagatctagaggacacggtccgtagtacgttacgtgtgcgtacgacgtacccgaaagtactacgcgacgcgtcggtcggggtaggtcgggttaccgaccccggtggggcccgacggggaaccctcgggtaccaccgtccgtccctcgtacgtcttcccaaccgaacgggaccctacgtccgttcccttccccgtacggtcccgcccgtcgccgtcccgacggccgccaccgtcggtcggggccacgcgccggccgtcggcgtcgcgtcggtacgacgtacttacctctatctctgtctgngtcgg

SEQ ID NO: 280930 - DNA, 570 bp, Homo sapiens
  misc_feature: GYAE6OF02JD20C.44.43.D10.1.454.CMB.1.raw
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
  modified_base (537)..(537): a, c, t, g, unknown or other
  misc_feature (537)..(537): n is a, c, g, or t
  modified_base (547)..(547): a, c, t, g, unknown or other
  misc_feature (547)..(547): n is a, c, g, or t
tcagacagtatatacacgaccggtgctcgatttagactagcagtaagggggaactgctcagttaggacccagagggaaccatggaagccccagcgcagcttctcttcctcctgctactctggctcccagataccactggagaaatagtgatgacacagtctccaggcaccctgtctttgtctccaggggagagacgccaccctctcctgtaggccagtcggagtgttgctaagtacctagcctggtaccaacagaaacctggccaggcctccaggctccncatctatgatgcatccaacgagggtcacgtcgccaccccagacaggttcagtggcaggtggtctagggctagtaccttcactctcacgtcagcatcgacagcctgaagtntttgactagttttatacgtgttacacgtcgtagtccgttcctaccgacgcccgtctacgtcggtttccggggaccgggggtacaagggttcgggactacgttaccgaagtaccgtaacgtggtaggcgtcgacctaccgctccgttnttccgttacncgttccgtccctcctagttaccg

SEQ ID NO: 280931 - DNA, 777 bp, Homo sapiens
  misc_feature: GYAE6OF02JERM3.44.43.D10.1.454.CMB.1.raw
  modified_base (159)..(159): a, c, t, g, unknown or other
  misc_feature (159)..(159): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (304)..(304): a, c, t, g, unknown or other
  misc_feature (304)..(304): n is a, c, g, or t
tcagacagtatatacacgaccggtgctcgatttagactagcagtaaggggaactgctcagttaggacccagaggaaccatggaacgccccagctcagcttctcttcctcctgctactctggcctcccagactaccaccggagacgattgtgttacgacncagtctccagccacctgtcttgctccgagggaancgccacctctccngcaggccagtcagngtcgttagccagtctacttacgcctaggtaacccaagtaacgaaaccgtcgccgtaaggtccttcccgaaggtccctaccgtanactacgtaagtcgggttcactaacgttacccgaaacgacgggtacctaggacggtaccaaccgttcccgacggaccgtaacggtttaccgacggttggaccgtaacggttcgggtacggtacggggaactaaccggtactttaccgaacctttcgaaccctacgtaattccgagaccgtaacgccgttaagacccgtcggttaacgtaacgttttctttaacgacgtttatttaacgtcgtaacgttaggttacccgagttacccgaacggttacctaaccggaaccgttacggtaaccggtcccgtaaaccgtttcccggtaaccgggttccgaaaccgggtaacggacccgttaacccgaagggttaagtaaaccgttaaaccgttaacggtaaaccctttgggaacgttacccgttaccggaacttaacccgtgtttaacccgttgttacccttaccgtcgttacccccg

SEQ ID NO: 280932 - DNA, 847 bp, Homo sapiens
  misc_feature: GYAE6OF02H4MQ2.44.43.D10.1.454.CMB.1.raw
  modified_base (82)..(82): a, c, t, g, unknown or other
  misc_feature (82)..(82): n is a, c, g, or t
  modified_base (171)..(171): a, c, t, g, unknown or other
  misc_feature (171)..(171): n is a, c, g, or t
  modified_base (755)..(755): a, c, t, g, unknown or other
  misc_feature (755)..(755): n is a, c, g, or t
tcagacagtatatacacgaccggtgctcgatttagactagcagtaagggggaactgctcagttaggacccagagggaaccanggaagcccagctcacgcttcctcttccctcctgactctctcggcctccagactacccgacggagagattgtcgttcgacgctacgtccncctagccctacccttcgttctttcgtccctacccggtaaaggggaaacgccgaccctaccgtcccttcccgtgccgaacgggcccgtacgtccgaaggtcgttggttaacgcgtacggtaccttaacgttacgtaccgttaccggtaaacaaccgtaacggaaacccgtcgggtaacccgtacggacccgtacccgtacggccttaacccacgtaacgtcttacgtacggtacaccgacttacccgaacggtaccggtacccaacggttccgtaccctacggtacccctaagggtaccccgttaacgggttacctaacccgggttaggggtaacccgttaggggttacccggggttaccggtaaacggacggtaaaccggttcctttaccggtacctaaccggtcccttaaacgaacgttccgaacgtccacggttacgtacgtaccgtacgttaacgtacgtagtttactacggtaagttcgcgttaagtacgtaccgtaacgtaactacggtacgtacaaaccgttagtaccggtaacccgcctaccggtacccgtacggaacgtaacgaccggttaaccgnggttaacacgttaacgtaccgtaacggttctaaccgtggttaaccacgtaaccgttacaccgttaccgtttactaccggttaaccttcccgg

SEQ ID NO: 280933 - DNA, 516 bp, Homo sapiens
  misc_feature: GYAE6OF01DN83B.38.38.D05.1.454.CMB.1.raw
  modified_base (351)..(351): a, c, t, g, unknown or other
  misc_feature (351)..(351): n is a, c, g, or t
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtcttgggtctcctggacagtcgatcaccatctcctgcactggaagcagtaggtgacatttggtggttataacgtatgtctcctggtaccaacaacacccaggcaaagccccaaactcatcatttatgacgtcactcatcggcctcaggggtttctactcgcttctctggctccaagttttggcaacacggcctcctgaccatttcngggctccaggctgaggcaggctgaattttattgctcctcatatacaggcagcagcaccccttatgtcttcggaactgggaccaaggtcaaccgtcctacgtcagcccaaggccaacccactgtcactctgtcccacctcctcacgtnactcgactggncgggtcg

SEQ ID NO: 280934 - DNA, 512 bp, Homo sapiens
  misc_feature: GYAE6OF01EDMRC.38.38.D05.1.454.CMB.1.raw
  modified_base (467)..(467): a, c, t, g, unknown or other
  misc_feature (467)..(467): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtcctacgtcagcccaaggccaacccntgtcactctcgttcccgccctcctcacgtgatcgactgagcgggc

SEQ ID NO: 280935 - DNA, 299 bp, Homo sapiens
  misc_feature: GYAE6OF01BD3PP.38.38.D05.1.454.CMB.1.raw
  modified_base (293)..(299): a, c, t, g, unknown or other
  misc_feature (293)..(299): n is a, c, g, or t
tcagtcgatcacgtcacgaccggtgctcgatttagtatctgatagttgggtttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaacccactgtcactctgttcccgccctcctcacgtgatcgactgagcgggctggcaaggcgcatagnnnnnnn

SEQ ID NO: 280936 - DNA, 291 bp, Homo sapiens
  misc_feature: GYAE6OF01DSLF6.38.38.D05.1.454.CMB.1.raw
  modified_base (288)..(291): a, c, t, g, unknown or other
  misc_feature (288)..(291): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccgccctcctcacgtgatcgactgagcgggctggcaaggcgcatagnnnn

SEQ ID NO: 280937 - DNA, 294 bp, Homo sapiens
  misc_feature: GYAE6OF01CRYKJ.38.38.D05.1.454.CMB.1.raw
  modified_base (287)..(294): a, c, t, g, unknown or other
  misc_feature (287)..(294): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccacctcctcacgtgatcgactgagcgggctggcaaggcgcatagnnnnnnnn

SEQ ID NO: 280938 - DNA, 316 bp, Homo sapiens
  misc_feature: GYAE6OF01AP7YT.38.38.D05.1.454.CMB.1.raw
  modified_base (292)..(292): a, c, t, g, unknown or other
  misc_feature (292)..(292): n is a, c, g, or t
  modified_base (294)..(296): a, c, t, g, unknown or other
  misc_feature (294)..(296): n is a, c, g, or t
  modified_base (298)..(316): a, c, t, g, unknown or other
  misc_feature (298)..(316): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcagcccaaggccaaccccatgtcactctgttcccgcctcctcacgtgatcgactgagcggctggcaaggcgacatagnannnannnnnnnnnnnnnnnnnnn

SEQ ID NO: 280939 - DNA, 526 bp, Homo sapiens
  misc_feature: GYAE6OF01ACCGV.38.38.D05.1.454.CMB.1.raw
  modified_base (415)..(415): a, c, t, g, unknown or other
  misc_feature (415)..(415): n is a, c, g, or t
  modified_base (501)..(501): a, c, t, g, unknown or other
  misc_feature (501)..(501): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttancgtcttcggaactgggaccaaggtccaccgtcctacgtcagcccaaggccaaccccactcgtccactcctcgttccccgccctccnccacgtcgactcgactgagcggtcg

SEQ ID NO: 280940 - DNA, 460 bp, Homo sapiens
  misc_feature: GYAE6OF01EGJ6T.38.38.D05.1.454.CMB.1.raw
  modified_base (445)..(445): a, c, t, g, unknown or other
  misc_feature (445)..(445): n is a, c, g, or t
  modified_base (451)..(460): a, c, t, g, unknown or other
  misc_feature (451)..(460): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggcccaaccccactgtcactctcgttccccaccctcctcacgtgatcgactgagcggctggcaaggcncatagnnnnnnnnnn

SEQ ID NO: 280941 - DNA, 515 bp, Homo sapiens
  misc_feature: GYAE6OF01ASO3U.38.38.D05.1.454.CMB.1.raw
  modified_base (411)..(411): a, c, t, g, unknown or other
  misc_feature (411)..(411): n is a, c, g, or t
  modified_base (464)..(464): a, c, t, g, unknown or other
  misc_feature (464)..(464): n is a, c, g, or t
  modified_base (508)..(508): a, c, t, g, unknown or other
  misc_feature (508)..(508): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaattttatgctctcatatacaggcagcagcacccttangtctcggaactgggaccaaggtcacgtcctacgtcacgcccaaggccaacccnctcgtccactctcgttccccgccctcctcacgtgactcgactgngcgggtc

SEQ ID NO: 280942 - DNA, 459 bp, Homo sapiens
  misc_feature: GYAE6OF01A9ADN.38.38.D05.1.454.CMB.1.raw
  modified_base (450)..(459): a, c, t, g, unknown or other
  misc_feature (450)..(459): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctcccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccgccctcctcacgtgatcgactgagcgggctggcaaggcgcatagnnnnnnnnnn

SEQ ID NO: 280943 - DNA, 292 bp, Homo sapiens
  misc_feature: GYAE6OF01CLXKB.38.38.D05.1.454.CMB.1.raw
  modified_base (287)..(292): a, c, t, g, unknown or other
  misc_feature (287)..(292): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccgcctcctcacgtgatcgactgagcgggctggcaaggcgcatagnnnnnn

SEQ ID NO: 280944 - DNA, 520 bp, Homo sapiens
  misc_feature: GYAE6OF01D0N2E.38.38.D05.1.454.CMB.1.raw
  modified_base (469)..(469): a, c, t, g, unknown or other
  misc_feature (469)..(469): n is a, c, g, or t
  modified_base (514)..(514): a, c, t, g, unknown or other
  misc_feature (514)..(514): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggcgaggctgaattttatgctcctcatatacaggcagcagcaccccttatgtcttcggaactgggaccaaggtcaccgtcctacgtcagcccaaggcccaaccccnctcgccactctcgttccccgcccttcctcacgtcgactcgactgngcgggc

SEQ ID NO: 280945 - DNA, 457 bp, Homo sapiens
  misc_feature: GYAE6OF01BNJI3.38.38.D05.1.454.CMB.1.raw
  modified_base (444)..(444): a, c, t, g, unknown or other
  misc_feature (444)..(444): n is a, c, g, or t
  modified_base (449)..(457): a, c, t, g, unknown or other
  misc_feature (449)..(457): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtctacgtcacgcccaaggcccaaccccactgtccactctcgttccccgcctcctcacgtgatcgactgagcggctggcaaggcncatgnnnnnnnnn

SEQ ID NO: 280946 - DNA, 515 bp, Homo sapiens
  misc_feature: GYAE6OF01B1HJS.38.38.D05.1.454.CMB.1.raw
  modified_base (467)..(467): a, c, t, g, unknown or other
  misc_feature (467)..(467): n is a, c, g, or t
  modified_base (493)..(493): a, c, t, g, unknown or other
  misc_feature (493)..(493): n is a, c, g, or t
  modified_base (509)..(509): a, c, t, g, unknown or other
  misc_feature (509)..(509): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagccacccttatgtcttcggactgggaccaggtcaccgtctacgtcagcccaaggcccaacccnctgtccactctcgttcccaccctccncacgtgactcgactgngcggcg

SEQ ID NO: 280947 - DNA, 461 bp, Homo sapiens
  misc_feature: GYAE6OF01BLTX3.38.38.D05.1.454.CMB.1.raw
  modified_base (444)..(444): a, c, t, g, unknown or other
  misc_feature (444)..(444): n is a, c, g, or t
  modified_base (450)..(461): a, c, t, g, unknown or other
  misc_feature (450)..(461): n is a, c, g, or t
tcagtcgatcacgtcacgaccggtgctcgatttagtatctgatagttgggtttggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcagcccaaggcccaaccccactgtcactctcgttccccaccctcctcacgtgatcgactgagcgggctggcaaggcncatagnnnnnnnnnnnn

SEQ ID NO: 280948 - DNA, 461 bp, Homo sapiens
  misc_feature: GYAE6OF01ADKTI.38.38.D05.1.454.CMB.1.raw
  modified_base (445)..(445): a, c, t, g, unknown or other
  misc_feature (445)..(445): n is a, c, g, or t
  modified_base (450)..(461): a, c, t, g, unknown or other
  misc_feature (450)..(461): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggcccaaccccactgtcactctgttccccgccctcctcacgtgatcgactgagcgggctggcaaggcncatgnnnnnnnnnnnn

SEQ ID NO: 280949 - DNA, 299 bp, Homo sapiens
  misc_feature: GYAE6OF01CTTLD.38.38.D05.1.454.CMB.1.raw
  modified_base (294)..(299): a, c, t, g, unknown or other
  misc_feature (294)..(299): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaacccactgtcactctgttcccaccctcctcacgtgatcgactgagcgggctggcaaggcgcatagnnnnnn

SEQ ID NO: 280950 - DNA, 355 bp, Homo sapiens
  misc_feature: GYAE6OF01BL35P.38.38.D05.1.454.CMB.1.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (340)..(355): a, c, t, g, unknown or other
  misc_feature (340)..(355): n is a, c, g, or t
tcagtcgatcacgtcacgaccggtgctcgatttagtatctgatagttgggtttgggaacctatgaacattctgtagggccactgtcttctccacggtgctcccttctactcgcttctctggctccaagtttggcaacacggcctccctgaccatttctgggctccaggctgaggacgaggctgaattttattgctcctcatatacaggcagcagcaccccttangtcttcggaactgggaccaaggtcaccgtcctacgtcagcccaaggccaaccccntgtcactctgttcccgccctcctcacgtgactcgactgagcgggctggcaaggcgcatagnnnnnnnnnnnnnnnn

SEQ ID NO: 280951 - DNA, 520 bp, Homo sapiens
  misc_feature: GYAE6OF01CKRT8.38.38.D05.1.454.CMB.1.raw
  modified_base (470)..(470): a, c, t, g, unknown or other
  misc_feature (470)..(470): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagccaccccttatgtcttcggaactgggaccaaggtcaccgtcctacgtcagcccaaggccaaccccnctcgtccactctcgttcccgccctcctcacgtgactcgatgagcgggtcg

SEQ ID NO: 280952 - DNA, 462 bp, Homo sapiens
  misc_feature: GYAE6OF01ASK90.38.38.D05.1.454.CMB.1.raw
  modified_base (453)..(462): a, c, t, g, unknown or other
  misc_feature (453)..(462): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaggtcacgtcctacgtcagcccaaggcccaaccccactcgtccactcctgttccccaccctcctcacgtcgatcgactgagcgggctggcaaggcgcatagnnnnnnnnnn

SEQ ID NO: 280953 - DNA, 304 bp, Homo sapiens
  misc_feature: GYAE6OF01DV38W.38.38.D05.1.454.CMB.1.raw
  modified_base (295)..(304): a, c, t, g, unknown or other
  misc_feature (295)..(304): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccaccctcctcacgtgatcgactgagcgggctggcaaggcgcatagnnnnnnnnnn

SEQ ID NO: 280954 - DNA, 513 bp, Homo sapiens
  misc_feature: GYAE6OF01DWIJN.38.38.D05.1.454.CMB.1.raw
  modified_base (349)..(349): a, c, t, g, unknown or other
  misc_feature (349)..(349): n is a, c, g, or t
  modified_base (468)..(468): a, c, t, g, unknown or other
  misc_feature (468)..(468): n is a, c, g, or t
  modified_base (507)..(507): a, c, t, g, unknown or other
  misc_feature (507)..(507): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggcctcaggggtttctactcgcttctctggctccaagtttggctaacacggcctcctgaccatttcngggctccaggctgaggacgaggctgaattttatgctcctcatatacaggcagcagccacccttatcgtcttcggaactgggaccaaggtccaccgtctacgtcagcccacgccaacccntcgtcactctcgttcccgcctcctcacgtgactcgatgngcggcg

SEQ ID NO: 280955 - DNA, 605 bp, Homo sapiens
  misc_feature: GYAE6OF01AQXT5.38.38.D05.1.454.CMB.1.raw
  modified_base (467)..(467): a, c, t, g, unknown or other
  misc_feature (467)..(467): n is a, c, g, or t
  modified_base (485)..(485): a, c, t, g, unknown or other
  misc_feature (485)..(485): n is a, c, g, or t
tcagtcgatcacgtcacgaccggtgctcgatttagtatctgatagtgggggttggggcttgcctgggctctggctgctcctcacccgtcctcactcgaccgggcacagggtcctgggcccgagtcctgccctgactcgagcctgcctccgtgtctgggtctcctggaccagtcgatccacctatcctcctcgccactcggaagcagtagtggacattggtggttataactatgtctcctggtaccgaacaacacccaggcaaacgcccctaaaacgtcaattactatttaatcgaacgtcaaacctacgaactcccggccctactacgggggtttctaacctcgtctttcgttcctggtccttacctaagttttcggctaaaccgtccggggccctccctggaacctattcgtgggctcgaggctggtagggacgaggctgtaacttttatcgctcctcactatacnggtcagcagctacccttncgttcttacgtacgtggaccaaggtcaccgtcctacgtccacgtaccctacggccccaaccgctacgtccaccgtctcgtaccccaccgtcctcgcgtcgctccgactcgtggcggtacg

SEQ ID NO: 280956 - DNA, 532 bp, Homo sapiens
  misc_feature: GYAE6OF01D18ZR.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggcgaggctgtaattttattgctcctcatatacgggcagcagccaccccttatcgtcttcggaactgggaccaaggtcaccgtcctacgtcacgcccaaggcccaaccccactcgtccacctctcgttccccaccctcctcacgtgactcgactgacgcgggctcggg

SEQ ID NO: 280957 - DNA, 525 bp, Homo sapiens
  misc_feature: GYAE6OF01AZCQC.38.38.D05.1.454.CMB.1.raw
  modified_base (470)..(470): a, c, t, g, unknown or other
  misc_feature (470)..(470): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgacccatttctgggctccaggctgaggacgaggctgaattttatgctcctcatatacaggcagcagcaccccttatgtcttcggaactgggaccaaggtcaccgtctacgtcagcccaaggcccaaccccnctcgtccacctctcgttccccgcccttcctcacgtcgactcgatcgagcgggtcg

SEQ ID NO: 280958 - DNA, 560 bp, Homo sapiens
  misc_feature: GYAE6OF01AXHWU.38.38.D05.1.454.CMB.1.raw
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
  modified_base (519)..(519): a, c, t, g, unknown or other
  misc_feature (519)..(519): n is a, c, g, or t
tcagtcgatcacgtcacgaccggtgctcgatttagtatctgatagttgggtttggggctttgcctgggtactctgctgctccgtcaccctccgtcacgtcgacggggcacctagggttcctgggccccaggtctcgccctgactcacgcctgcctccgtgtcgtagggtctccttggacacgttcgatcaccatctccgtgcaactcggaagcgagtagtgacgattggtgttataactatgtctctggtaccaacaactaccaaggcaaacgcccccaaactcatcgactttatgacgtcactcactcggcctcaggggttcaactcgcttctctggctccgaagtttggacaacacggctcctgaccattcgnggctcagctgagtacgngtctgtactttntcgctcgtctatacgtacaggacngcacgccacccttncgtctccgaactcggaccacgtcaccgtcctaccgtcacgcccacgacccaacccgctctaccactcgtccgtcccnccctccgtccgacgtcgactcgacctcggcggcgggtaccg

SEQ ID NO: 280959 - DNA, 298 bp, Homo sapiens
  misc_feature: GYAE6OF01CRL34.38.38.D05.1.454.CMB.1.raw
  modified_base (286)..(298): a, c, t, g, unknown or other
  misc_feature (286)..(298): n is a, c, g, or t
tcagtcgatcacgtcacgaccggtgctcgatttagtatctgatagttgggtttctactcggcttctctggctccaagttggcaacacggcctccctgaccatttctgggctccaggctgaggacgaggctgaattttattgctcctcatatacaggcagcagcacccttatgtcttcggaactgggaccaaggtcaccgtcctacgtcagcccaaggccaaccccactgtcactctgttcccacctcctcacgtgatcgactgagcgggctggcaaggcgcatagnnnnnnnnnnnnn

SEQ ID NO: 280960 - DNA, 579 bp, Homo sapiens
  misc_feature: GYAE6OF01A3HB9.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggcccctcgtagggtttctactcgcttctctgctcctagttgacaacgacgcctcctgacctatttcgtcgggtcctccgaggctggaggacgaggtctagtaattttagtcgtcttcctactatactacgaggcacgcacgcctacccttatcgtcgttacggaacgtcgggaacccaaggtccaccgttcctacgtcaccgacccaacggaccccaaccccgtctccgtacctaccttccgtccgttaccccgccccttcctccgtacgttcgtactacgacgtggcggcgggtcg

SEQ ID NO: 280961 - DNA, 489 bp, Homo sapiens
  misc_feature: GYAE6OF01E2XOO.38.38.D05.1.454.CMB.1.raw
  modified_base (270)..(270): a, c, t, g, unknown or other
  misc_feature (270)..(270): n is a, c, g, or t
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (458)..(460): a, c, t, g, unknown or other
  misc_feature (458)..(460): n is a, c, g, or t
  modified_base (462)..(463): a, c, t, g, unknown or other
  misc_feature (462)..(463): n is a, c, g, or t
  modified_base (465)..(468): a, c, t, g, unknown or other
  misc_feature (465)..(468): n is a, c, g, or t
  modified_base (471)..(473): a, c, t, g, unknown or other
  misc_feature (471)..(473): n is a, c, g, or t
  modified_base (475)..(479): a, c, t, g, unknown or other
  misc_feature (475)..(479): n is a, c, g, or t
  modified_base (482)..(489): a, c, t, g, unknown or other
  misc_feature (482)..(489): n is a, c, g, or t
tcagtcgatcacgtcacgaccggtgctcgatttagtatctgatagttgggtttgggggcttcgtctgggtctcctggacagtcgatcaccatcctcctgcactggaagcagtagtgacattggtggttataactatgtctcctggtaccaacaacacccaggcaaagcccccaaactcatcatttatgacgtcactcatcggccctcaggggtttcctactcgcttctctggctccaagtttggctaacacggcctccctgaccatttcngggctccaggctgagacgagctgattttattgctcctnatatacaggcagcagcaccccttatcgtcttcggaactggaccaaggtcaccgtctacgtcacgcccaacggcccaaccccnctcgtaccacttcncgttccccgcctcctcacgtgactcgaactgagccggctggcaaggcgcagtgnnntnncnnnntgnnngnnnnngannnnnnnn

SEQ ID NO: 280962 - DNA, 536 bp, Homo sapiens
  misc_feature: GYAE6OF01BGUPV.38.38.D05.1.454.CMB.1.raw
  modified_base (467)..(467): a, c, t, g, unknown or other
  misc_feature (467)..(467): n is a, c, g, or t
  modified_base (504)..(504): a, c, t, g, unknown or other
  misc_feature (504)..(504): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcacccttatgtcttcggactgggaccaggtcaccgtctacgtcagcccaaggcccaaccccnctcgtaccaccttccgtcgttcccccgccccttcccnccgtacgtcgtactcgactggacgcgggtacg

SEQ ID NO: 280963 - DNA, 609 bp, Homo sapiens
  misc_feature: GYAE6OF01EHMF3.38.38.D05.1.454.CMB.1.raw
  modified_base (365)..(365): a, c, t, g, unknown or other
  misc_feature (365)..(365): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtcctcctggacagtcgatcaccatctcctgcactggaagcagtagtgactattggtggttaataactatgtcctcctggtaccaacaacacccaggacaaacgcccccaaactcatctatttatgacgtcactcatccggccctcgtaggggtttctactcgtcttctctggctcctaagtttggacaacacggcctccctgacctatttcgngggcctccgaggctggaggacgaggtctagtaattttatgtctcctcatatacgaggcagcacgcctacccctttatcgttcgttaccggaacgtcgggaacctaaggtccctacccgttccctaccgtcaccgccccgaacggaccccaaccccactcgtcctaccttccgttccgttcccccgccccttccctaccgtaccgttacgtacctaccggtaccttcggacggtccgggtaccgg

SEQ ID NO: 280964 - DNA, 543 bp, Homo sapiens
  misc_feature: GYAE6OF01A91UX.38.38.D05.1.454.CMB.1.raw
  modified_base (396)..(396): a, c, t, g, unknown or other
  misc_feature (396)..(396): n is a, c, g, or t
  modified_base (512)..(512): a, c, t, g, unknown or other
  misc_feature (512)..(512): n is a, c, g, or t
  modified_base (535)..(535): a, c, t, g, unknown or other
  misc_feature (535)..(535): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaacgccccaaactcatcatttatgacgtcactcatcggcctcgaggggtttctactcgcttctctgctcaagtttgcaacacgcctcctgacctatttcgtgggctccgaggctggacggacgaggcttagtaatttttatcgtcttcctnattatacgaggcagcacgcctaccccttatcgtctacggactcgggaccaaggtccaccgtcctacgtcacgacccaacggacccaaccctctcgtccacttccgtccgttccccnccctctccacgtgctcgactcgngcgggtcg

SEQ ID NO: 280965 - DNA, 511 bp, Homo sapiens
  misc_feature: GYAE6OF01C32JL.38.38.D05.1.454.CMB.1.raw
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (501)..(501): a, c, t, g, unknown or other
  misc_feature (501)..(501): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataaccatgtctcctggtaccaacatcacccagacaacggcccccaaactcataatttatgacgtcagtagtcggcctcgaggggtttctgatcgcttctcaggctcaagtctggcaacaccggcctcctgaccatctcgtcgggctccgaggttgaggacgaggctagacttattattcgcgtcctcacatggaatcgaggtagggtttcggacggaggacaagtcgacgtctaggcagccagcncgccctgcactctcgtcccncctctcacgtnctcgactgacgcggntcggcaggcg

SEQ ID NO: 280966 - DNA, 527 bp, Homo sapiens
  misc_feature: GYAE6OF01B35UF.38.38.D05.1.454.CMB.1.raw
  modified_base (497)..(497): a, c, t, g, unknown or other
  misc_feature (497)..(497): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagcagtgacattggtcattataactctgtctcgtggtaccaacaacaccaggccaagccccaaatcattattatgaggtccgaatcggcctgaggaatttcaatcgcttctctggctccaagtctggcaacacggcctccctgaccatctctggacctccaggctggaggacgaggctgatttactacgtgcagtttcattatacaagccactactcctcttctgtttactcgggcggaggaccagggtcaccgtctaagtccagcccaaggtccttcgtcccctggtcaccttgtcggttccccncccttcctcgacgtcgatcgacgtggacgg

SEQ ID NO: 280967 - DNA, 535 bp, Homo sapiens
  misc_feature: GYAE6OF01BV3I8.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgtctcctcatatacaggcagcagcctaccccttatcgtcttcggactgggaccaggtcaccgtcctacgtcacgcccaaggcccaacccactcgtcctacttccgttcgttcccctaccctccctcaccgtcgactcgactgacgcgggtcg

SEQ ID NO: 280968 - DNA, 601 bp, Homo sapiens
  misc_feature: GYAE6OF01B2MYY.38.38.D05.1.454.CMB.1.raw
tcagtcgatcacgtcacgaccggtgctcgatttagtatctgatagttgggtttggggctttgcctagggctctgctgctcctcaccctcctcactcaggcacagggtcctgggcccagtctgccctgactcagcctgcctccgtgtctgggtctcctggacagtcgatcaccatctcctgcactggaagcagtagtgacatttggtgttaataactatgtctctggtaccaacacaccaggcaaacgccccaaactcatctatttatgacgtcactcactccggccctcgtacggggtttctactcgtcttctcgtggctactaagtttcggaccaaacgaccggtcctcctacgacctatttcgtacgggcttccgaggctaggacggacgagtcttagtaattttagtgctcctcatactacaggcagcagacctacccttatcgtcttacggaacttcgggaacctacggtccaaccgtcctacgtacgacgacccgtaacggacccaaacccgtctcgtacctaccttccgttccgttaccccaccccttcctaccgtacgttacgtacttaccgacgttggacggccgggtaccgg

SEQ ID NO: 280969 - DNA, 568 bp, Homo sapiens
  misc_feature: GYAE6OF01C808U.38.38.D05.1.454.CMB.1.raw
  modified_base (557)..(557): a, c, t, g, unknown or other
  misc_feature (557)..(557): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcagggtttctactcgcttctctggctccaagtttggcaacacggcctcctgacctatttctgggcctccgaggctggaggacgaggctgtaattttatgctctcatatacaggcagcacgcctacccctttagtcgttacgttaccggaacgttcgggaacccaagggtccaacccggtccgtacgtccgaacgccccaacggcccaacccctactcgtcccaccttccgtcgttccccacccttcctccacgttcgactccgactcgnggcgggtaccg

SEQ ID NO: 280970 - DNA, 476 bp, Homo sapiens
  misc_feature: GYAE6OF01CFJSR.38.38.D05.1.454.CMB.1.raw
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
  modified_base (454)..(454): a, c, t, g, unknown or other
  misc_feature (454)..(454): n is a, c, g, or t
  modified_base (460)..(476): a, c, t, g, unknown or other
  misc_feature (460)..(476): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcgaggggtttctactcgcttctctggctcaagtttggcaacncggcctccctgaccatttctgggctccaggctgaggacgaggctgaattttatgctcctnatatacaggcagcagccaccccttatgtctcggaactggaccaaggtcaccgtctacgtcacgcccaaggcccaaccccactcgtcaccttcctcgttccccgccctcctcacgtcgactccgatgacggcgggctggacaaggtcncatgcnnnnnnnnnnnnnnnnn

SEQ ID NO: 280971 - DNA, 530 bp, Homo sapiens
  misc_feature: GYAE6OF01D7O66.38.38.D05.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttcngggctccaggctgaggacgaggctagaattttatgctcctcatatacaggcagcacgcctaccccttatgtcttcggaactgggaccaaggtcaccgtcctacgtcacgcccaaggcccaacccactcgtccactcctcgttccccacccttccacacgtcgactacgactgcgcgggtcg

SEQ ID NO: 280972 - DNA, 310 bp, Homo sapiens
  misc_feature: GYAE6OF01BTD89.38.38.D05.1.454.CMB.1.raw
  modified_base (292)..(293): a, c, t, g, unknown or other
  misc_feature (292)..(293): n is a, c, g, or t
  modified_base (295)..(310): a, c, t, g, unknown or other
  misc_feature (295)..(310): n is a, c, g, or t
tcagtcgatcacgtcacgaccggtgctcgatttagtatctgatagttgggttgggtttcgtactcgcttctctggctccaagtttggcgaacacggcctccctgaccatttctcgggctccaggctgaggacgaggctgaattttattgcctctcatatacaggcagcagctaccccttatgtcttcggaactgggaccaaggtcaccgtcctacgtcagcccaaggccaacccactgtcactctgttcccgccctctcacgtgatcgactgagcggctggcaagcgcatgnncnnnnnnnnnnnnnnnn

SEQ ID NO: 280973 - DNA, 534 bp, Homo sapiens
  misc_feature: GYAE6OF01CFP81.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaaacaacacccaggcaaacgccccaaactcatcatttatgacgtcactcatcggccctcaggggtttctactcgcttctctggctccaagtttggcaacacggcctccctgacctattctgggctccaggctggaggacgaggctgtaatttatgctcctcatatacaggcagcagcaccccttatcgtcttcggaactgggacctaacggtcaccgtcctacgtcacgacccaacggcccaacccgctcgtccactccgtcgttccccgccctcctcacgtcgactccagtcgcggcggtcg

SEQ ID NO: 280974 - DNA, 453 bp, Homo sapiens
  misc_feature: GYAE6OF01C3HD9.38.38.D05.1.454.CMB.1.raw
  modified_base (407)..(407): a, c, t, g, unknown or other
  misc_feature (407)..(407): n is a, c, g, or t
  modified_base (444)..(444): a, c, t, g, unknown or other
  misc_feature (444)..(444): n is a, c, g, or t
  modified_base (448)..(453): a, c, t, g, unknown or other
  misc_feature (448)..(453): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcacgcccaaggcccaacccactgtcactctcgttccccnccctctcacgtgactcgactgagcgggctggcaggcnatgnnnnnn

SEQ ID NO: 280975 - DNA, 555 bp, Homo sapiens
  misc_feature: GYAE6OF01CNURQ.38.38.D05.1.454.CMB.1.raw
  modified_base (545)..(545): a, c, t, g, unknown or other
  misc_feature (545)..(545): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcattatgacgtcactcatcgccctcgtaggggtttccactcgcttctctggtctcctaagtttcggacaacgacggccctccctgacctatttcgtcgggcctccgaggctggacggacgaggtctagtaattttatgtctcctctatatacaggcagcacgccacccctttatcgtcttacggtaacgtcgggaccaacggtccaccgtcctacgtcacgacccaacgcccaaccctactctccacctcgtccgtccccgccctcctccacgtcgactcgancgcgcggtcg

SEQ ID NO: 280976 - DNA, 557 bp, Homo sapiens
  misc_feature: GYAE6OF01CQX43.38.38.D05.1.454.CMB.1.raw
  modified_base (390)..(390): a, c, t, g, unknown or other
  misc_feature (390)..(390): n is a, c, g, or t
  modified_base (547)..(547): a, c, t, g, unknown or other
  misc_feature (547)..(547): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttaataactatgtctcctggtaccaacaacacccaggcaaacgccccaaactcatcatttatgacgtcactcatcggccctcgaggggtttctactcgtcttctctggctcaagtttgcacacggcctcctgactatttctgggctcaggctgaggacgaggctagtatttattgctcctnatatacgagcagcagccctacccttagtcgtccgttacggtaacgtcgggaacctacggtcctaccgtcctacgtacacgacccgaacgcccaaccctacgtcgtacctacctccgttccgtcccctaccctcctaccacgtcgtactcgactcggnggcgggtccg

SEQ ID NO: 280977 - DNA, 548 bp, Homo sapiens
  misc_feature: GYAE6OF01CIC9B.38.38.D05.1.454.CMB.1.raw
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtgttataactatgtctctggtaccaacaacacccaggcaaacgccccaaactcatcatttatgacgtcactcatcggccctcgtaggggtttctactcgcttctctggctccaagtttggctaacacggcctcctcgacctatttcgtgggctccgaggctggacggacgaggctagtaattttattcgctcctctatatacagcagcagcctacccttatcgtcgttacggaacgtggacctaaggtccaccgttcctacgtcacgacccaacggacccaacccgctacgtcctactccgtcgtcccgccctcctcacgtcnctacgactcgngcggtacg

SEQ ID NO: 280978 - DNA, 512 bp, Homo sapiens
  misc_feature: GYAE6OF01DWVSU.38.38.D05.1.454.CMB.1.raw
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgtctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggcctcagggtttcactcgcttctctggctccaagtttggctaacacggccctcctcgacctatttctgggctccaggctgaggacgaggctgaattttatgctcctnatatacagcagcagcacccttancgtcttcggaactgggaccaggtcaccgtctagtcagcccaagccaacccntgcactctcgttcccgccttccncacgtacgntaccgatcgngcgggcg

SEQ ID NO: 280979 - DNA, 308 bp, Homo sapiens
  misc_feature: GYAE6OF01DQY0Q.38.38.D05.1.454.CMB.1.raw
  modified_base (294)..(294): a, c, t, g, unknown or other
  misc_feature (294)..(294): n is a, c, g, or t
  modified_base (300)..(308): a, c, t, g, unknown or other
  misc_feature (300)..(308): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaatttttattgctcctcatatacaggcagcagcaccccttatgtcttcggaactgggaccaaggtcaccgtcctacgtcagcccaaggcccaaaccccactgtcactctcgttccccaccctcctcacgtgatcgactgagcgggctggcaaggcncatagnnnnnnnnn

SEQ ID NO: 280980 - DNA, 542 bp, Homo sapiens
  misc_feature: GYAE6OF01BTMS9.38.38.D05.1.454.CMB.1.raw
  modified_base (379)..(379): a, c, t, g, unknown or other
  misc_feature (379)..(379): n is a, c, g, or t
  modified_base (487)..(487): a, c, t, g, unknown or other
  misc_feature (487)..(487): n is a, c, g, or t
  modified_base (517)..(517): a, c, t, g, unknown or other
  misc_feature (517)..(517): n is a, c, g, or t
  modified_base (534)..(534): a, c, t, g, unknown or other
  misc_feature (534)..(534): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtgttataactatgtctcctggtaacccaacaacacccaggcaaaacgcccccaaaatcatcatttaatgacgtcactcatcggccctcaggggtttctactcgctttctctggctccaagtttggctaacacgcctccctgacctatttctgggctcaggctgaggacgaggntgtaattttatgcttctcatatacaggcagcacgcctacccttatcgtcttacggaactgggaaccaaggtccaccgtcctacgtccacgccccaaggcccaaacccnctacgtcacttcgtccgttcccaccctccncaccgtgactcgatcgngcgggtcg

SEQ ID NO: 280981 - DNA, 715 bp, Homo sapiens
  misc_feature: GYAE6OF01B6YMI.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaacgccccaaactcatcatttatgacgtcactcatcggcctcgagggtttctactcgcttctctcggtctcctaagtttcggacaacgaccggtccctcctacgacctactcgtcgtcgggacctccgagggccgtcggaacggtacgaacggtaccttaaagtttacgttttcgtcgtacgtaagtttacctaattaacttaaacccaaaccgtaacgtaaccaaacctacccgttacgttacgtaccgttaacgtttccggggaaccgggtaacggggaacctaacgggtccgtacggtaaccccggttaccgttaaaccggttaccgaacggtaccccgaaacggtcccgtacccggtcccccccgttacgggtttacccaacccgtttccgttacccggttcccccgtccccttaccccgtacccgtaccggtcgtacgtaccggtacgtcgggacggtcccgggg

SEQ ID NO: 280982 - DNA, 522 bp, Homo sapiens
  misc_feature: GYAE6OF01APQEH.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcagcccaaggcccaaccccactcgtcactctcgttccccgccctcctcacgtcgactcgactgagcgggtc

SEQ ID NO: 280983 - DNA, 571 bp, Homo sapiens
  misc_feature: GYAE6OF01CX5WE.38.38.D05.1.454.CMB.1.raw
  modified_base (217)..(217): a, c, t, g, unknown or other
  misc_feature (217)..(217): n is a, c, g, or t
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactntgtctcctggtaccaacaacaccaggcaaaacgccccaaactcatcatttatgacgtcactcatcggccctcgagggtttctactcgtcttctctggctccaagtttggcaacacggcctcctgacctattcngggctcgaggctgaggacgaggctagtaattttatgctcctnatactacaggcagcacgcctaccccttatcgtacttacggaacgtgggaacctaaggtccaaccgttccctaaccgtccaacgtacccaacggacccaaccccactcgtaccaccttcctcccgttccccaccccgttccctaccgtaccgtcgacttccgattcggacggcgggtacg

SEQ ID NO: 280984 - DNA, 470 bp, Homo sapiens
  misc_feature: GYAE6OF01CA0PY.38.38.D05.1.454.CMB.1.raw
  modified_base (336)..(336): a, c, t, g, unknown or other
  misc_feature (336)..(336): n is a, c, g, or t
  modified_base (393)..(393): a, c, t, g, unknown or other
  misc_feature (393)..(393): n is a, c, g, or t
  modified_base (459)..(470): a, c, t, g, unknown or other
  misc_feature (459)..(470): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaaagcccccaaaactcatcatttatgacgtcactcatcggccctcaggggtttctactcgcttctctggctccaagtttggcaacacggcctccctgacctatttctgggctccaggctgaggacgaggctgtaattttatgctcctcatatacaggcagcagccacccttangtcttcggaactgggaccaaggtcaccgtctacgtcacgcccaaggcccaaaccccntgtcactctcgttccccgccctcctcacgtgactcgctgacggcgggctggcgaacgcgacatagnnnnnnnnnnnn

SEQ ID NO: 280985 - DNA, 307 bp, Homo sapiens
  misc_feature: GYAE6OF01BRZAM.38.38.D05.1.454.CMB.1.raw
  modified_base (160)..(160): a, c, t, g, unknown or other
  misc_feature (160)..(160): n is a, c, g, or t
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (292)..(307): a, c, t, g, unknown or other
  misc_feature (292)..(307): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctccccatatacaggcganganccctaccttagtctcgtacgaggtcgaacgagtccnccgtccgtctcgcacgacgacccaccatcgcnctctccgtcccncctccncncgnacncgtcgagcggcgtcgtcgacgacggcgactagagnnnnnnnnnnnnnnnn

SEQ ID NO: 280986 - DNA, 523 bp, Homo sapiens
  misc_feature: GYAE6OF01DY2JZ.38.38.D05.1.454.CMB.1.raw
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
  modified_base (517)..(517): a, c, t, g, unknown or other
  misc_feature (517)..(517): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaaccaacaacacccaggcaaacgccccaaactcatcatttatgacgtcactcatcggccctcaggggtttctactcgcttctctggctccaagtttggcaacacggcctcctgaccatttctgggctccaggctgaggacgaggctagtaattttattgctcctcatatacaggcagcagccaccccttatcgtcttcggaacgtcggaccaaggtccaccgtcctacgtcacgcccaaggcccaacccnctcncactctcgtcccacctccncacgtcgactcgactgngcggcg

SEQ ID NO: 280987 - DNA, 567 bp, Homo sapiens
  misc_feature: GYAE6OF01A62HK.38.38.D05.1.454.CMB.1.raw
  modified_base (407)..(407): a, c, t, g, unknown or other
  misc_feature (407)..(407): n is a, c, g, or t
  modified_base (500)..(500): a, c, t, g, unknown or other
  misc_feature (500)..(500): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaaccaacaacaccaggacaaacgccccaaactcatcatttatgacgtcactcactccggcctcgtaggggtttctactcgcttctctggctctagtttgacacaccggcctcctgacctagtttccgtgggtcctccgaggtcgtagacgggacgaggtctagtaattttagtcgctcctntatatacgagcagcacgcctacccttatcgtcgttacggacgtagggacctaggtccaccgttccacgtccacgacccaacgacccaaccctntcgtccacttccgtccgttccccgccctccacctcgttacgtactaccgtacgcgtcggcggtaccg

SEQ ID NO: 280988 - DNA, 510 bp, Homo sapiens
  misc_feature: GYAE6OF01EXJ2K.38.38.D05.1.454.CMB.1.raw
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (493)..(498): a, c, t, g, unknown or other
  misc_feature (493)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(505): a, c, t, g, unknown or other
  misc_feature (504)..(505): n is a, c, g, or t
  modified_base (507)..(509): a, c, t, g, unknown or other
  misc_feature (507)..(509): n is a, c, g, or t
tcagtcgatcacgtcacgaccggtgctcgatttagtatctgatagttgggggtttgggggctttgtctgggtctcctggacagtcgatcaccatctcctgcactggaagcagtagtgacattggtggttataactatgtctcctggtaccaacaacacccaggccaaagcccccaaactcatcatttatgacgtcactcatcggcctcaggggtttctactcgcttctctggctccaagtttggcaacacggcctcctgacctatttctggcctccgaggcctagaggacgaggctagaattttacttcgctcctcattatacgaggcagcagcctaccctttagtcgtcttcggaactcgggacctaaggtccaccgtctacgtcacgccaacggcccaacccntcgtcactctcgtccccncctcctcacgtcgacgtctgacgcggtctcggctaggcacagtagcagnctgatcgncgngnagcntgcnnnnnncncncnncnnnc

SEQ ID NO: 280989 - DNA, 717 bp, Homo sapiens
  misc_feature: GYAE6OF01CJ7IC.38.38.D05.1.454.CMB.1.raw
  modified_base (272)..(272): a, c, t, g, unknown or other
  misc_feature (272)..(272): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctaggtaaccaacaacacccgaggacaaacgccccaaactcatctatttangacgtcactcactccggcctcgtagggtttctactcgtcttctctgctcagttgacacacggcctctcgacctattcgtgggctccgaggctaggacggacgaggtctagttaatttacttcgtcctacctactaattacgtacgacggtcaacggtaccacgtaccccttaaccccgtttagtaccggtttaccgtttaaccgggtaaacgttaccggggaaacccgtaacgggttcccctaacccgggttcccgtaaccggtcccgtaaacccggaaccccgtaaaccgggacccccaaacccccgtacgttacccgtacccgttaacccttccccgttacccggtttacccccctaaccccgttccccttacccggtaaccggtttaccgtaacccgttacccggtaaccggtttacgggaccgggtcccggggtaacccgg

SEQ ID NO: 280990 - DNA, 578 bp, Homo sapiens
  misc_feature: GYAE6OF01D2J3M.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagtttggtgttaataactatgtctcctggtaaccaacaacacccaggcaaaacgccccaaactcatcatttatgacgtcactcatccggccctcgtagggtttctactcgcttctctggctctaagttgacaacaccggcctcctgacctattctcgggctccaggctggagacgaggtctagtaattttattcgcttcctacatatactaggcaggcacgcctacccttatcgttcttacggaacgtggaaccaaggtccaacgtccctagtccgacgacccaacgacccaacccgctacgtcctaacttcccgtccgttacccccacccgttccctaccgtaccgtcgtactccgagtcggtcggccgggtaccg

SEQ ID NO: 280991 - DNA, 713 bp, Homo sapiens
  misc_feature: GYAE6OF01D14HP.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtcctcgtggacagtcgatcacctatctcctgcacgtggaacgcagtagtgactagttggtagttaataactatcgtctcgtacggtaaccaacaaccaccgaggacaaaccgaccccaaactcatactatttatagacgtcactcacgtccggccctcggtacggggttttcctaccgtccgtctttcctcgtcggtcctaccgttaagtttcggacaaccgaccggtcccttacccgtacgaccttactttcgtcgggtccttacgacggtcgtaggaacggacggtacggtcgttaggtttaaatttttcgttcgtccttcctactaattaacgtacgacggcacgcaaccgcccttaaccctttagtcgttaccgttaccggaacgtacgggtaacctaacggtcctaacccgttaccgtaccgttacaaccgtaccccgtaaacggacccccctaaaccctcgttacgtaccctaaccgtttccgtttccccgggttaccccctccccttcccgtaccgtacgtacgtactccgaagttcggacgggcgggtaccgg

SEQ ID NO: 280992 - DNA, 553 bp, Homo sapiens
  misc_feature: GYAE6OF01AULQL.38.38.D05.1.454.CMB.1.raw
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgcccccaaatcatcatttatgacgtcactcatccggccctcgaggggtttctactcgcttctctggctccagtttggcaacacggcctcctgacctatttctgggctccaggctggaggacgagctagtaattttatgctcctnatatacaggcagcagcctacccttntcgtctacggactggaccaggtcaccgtcctacgtcacgtacccaacggcccaacccactcgtccaccttccgttccgttcccccgacccttcctccgtacgtcgtacttccgaacttcggacggtcgggtaccgg

SEQ ID NO: 280993 - DNA, 546 bp, Homo sapiens
  misc_feature: GYAE6OF01AM131.38.38.D05.1.454.CMB.1.raw
  modified_base (396)..(396): a, c, t, g, unknown or other
  misc_feature (396)..(396): n is a, c, g, or t
  modified_base (486)..(486): a, c, t, g, unknown or other
  misc_feature (486)..(486): n is a, c, g, or t
  modified_base (511)..(511): a, c, t, g, unknown or other
  misc_feature (511)..(511): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctgtaccaacacaccaggcaaacgccccaaatcatcatttatgacgtcactcatcggccctcgtagggtttctactcgcttctcgtggctctagtttcgacaacacggcctccctgacctatttcgcgggctccgaggctggaggacgtaggtctagtaattttatcgtctcctntatatacgaggcagcacgcctacccttatcgtcgtacggactggacctaggtccaccgtccgtacgtcacgacccgaacgcccaaccccntctaccaccttccgtccgttccccncctccctcaccgtcactccgatggcggcggtaccg

SEQ ID NO: 280994 - DNA, 593 bp, Homo sapiens
  misc_feature: GYAE6OF01BE9J8.38.38.D05.1.454.CMB.1.raw
  modified_base (190)..(190): a, c, t, g, unknown or other
  misc_feature (190)..(190): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagtcgatcacgtcacgaccggtgctcgatttagtatctgatagttgggtttgggggctttgcctgggctctgctgctcctcaccctcctcacgtcagggcacagggtcctgggcccagtctgccctgactcagcctgcctcgtgtctgggtctcctggacagtcgatcaccatctcctgcactggaancagtagtgacagttggtgttataactatgtctcctggtaccaacacaccaggcaaacgccccaaatcatcatttatgtacgtcactcatcggccctgacgggtttccactcgcttctctggctcaagtttggcacncggcctccgtgacctattcgngggctcaggctggaggacgaggctagtattttatcgtacttcctacatactacgaggcagcacgcctacccttagtcgtcttacggaacgtcggtacctaaggtccaaccgttcctacgtacgaccgtaccccgaacggtacccctaacccacgttccgtaccgtaccgttccgttacccgttaccccgtccccttccgtacctaccggtaccgtacgttcccggactcggacggtcccgggtacg

SEQ ID NO: 280995 - DNA, 299 bp, Homo sapiens
  misc_feature: GYAE6OF01C5HAQ.38.38.D05.1.454.CMB.1.raw
  modified_base (285)..(285): a, c, t, g, unknown or other
  misc_feature (285)..(285): n is a, c, g, or t
  modified_base (291)..(299): a, c, t, g, unknown or other
  misc_feature (291)..(299): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctcgttccccgccctcctcacgtgactcgactgagcgggctggcaaggcncatagnnnnnnnnn

SEQ ID NO: 280996 - DNA, 571 bp, Homo sapiens
  misc_feature: GYAE6OF01D1H50.38.38.D05.1.454.CMB.1.raw
  modified_base (345)..(345): a, c, t, g, unknown or other
  misc_feature (345)..(345): n is a, c, g, or t
  modified_base (419)..(419): a, c, t, g, unknown or other
  misc_feature (419)..(419): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctccgtaggtaaccaaacaacaccaggacaaacgccccaaactcatcattatgacgtcactcatcgcctgtagggtttcactcgcttctctgctcagtttgacacacgcctcctgacctattcgnggctcgaggctaggaggacgagtctagtaattttagtcgtctctactatatacaggacagcacgcctacccttntcgtcgttacggaacgtcggaacctaaggtccgtaccgttcctacgtaccacgacccgtaacggcccaacccgctcgtaccaacgtccgttccggttccccgtcccttccgaccgtacgtacgtactacgtacgtcggcggtccgggtacgg

SEQ ID NO: 280997 - DNA, 552 bp, Homo sapiens
  misc_feature: GYAE6OF01BS9LU.38.38.D05.1.454.CMB.1.raw
  modified_base (394)..(394): a, c, t, g, unknown or other
  misc_feature (394)..(394): n is a, c, g, or t
  modified_base (518)..(518): a, c, t, g, unknown or other
  misc_feature (518)..(518): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcatggtaccaacaacacccaggacaaacgccccaaactcatcattatgacgtcactcatcggccctcgaggggtttctactcgcttctctggctcaagtttgcaacacggcctcctgacctatttcgtggctccgaggctgaggacgaggtctagtaatttatcgtctcctntatatacgaggtcagcacgcctacccttatcgtcgttcggaacgtcgggacctaaggtccaccgtccgtacgtccacgtacccaacggcccaacccgctcgtactacctccgttacgttccccnccctcctacacgtcactcgacgtggcggtccggg

SEQ ID NO: 280998 - DNA, 606 bp, Homo sapiens
  misc_feature: GYAE6OF01DEW04.38.38.D05.1.454.CMB.1.raw
  modified_base (270)..(270): a, c, t, g, unknown or other
  misc_feature (270)..(270): n is a, c, g, or t
  modified_base (357)..(357): a, c, t, g, unknown or other
  misc_feature (357)..(357): n is a, c, g, or t
tcagtcgatcacgtcacgaccggtgctcgatttagtatctgatagttgggtttgggggctttgcctgggctctgctgctcctcaccctcctcactcagggctacagggtcctgggcccagtctgccctgactcagcctgccttccgtgtctgggtctccgtggacagtcgatcaccatctcctgcactggaacgcaggtacgtgacattggtgttataactatgtctctggaccaacaacaccagaccaagccccaaatcatctattacngacgtcactcgagtcgcccttgtagggtttctactcgtctttctctggctcgtaagtttggacacaccgcctcctgacctatttcgngggctccgaggtctaggagacgaggctagtaacttttatcgtctacctcaatatacaggtcaagacacgcctacccttatcgttacgttacggaacgtacgggacctaaggtcctaccggttacctacgtccgacgtacccaacggaccccaacccgtactcgtacctaccgttccgttccgttaccccgtccccttcctaccgtacgttacgtacgttaccggacgttacgggacggtccgggtacgg

SEQ ID NO: 280999 - DNA, 511 bp, Homo sapiens
  misc_feature: GYAE6OF01B6MV5.38.38.D05.1.454.CMB.1.raw
  modified_base (233)..(233): a, c, t, g, unknown or other
  misc_feature (233)..(233): n is a, c, g, or t
  modified_base (266)..(266): a, c, t, g, unknown or other
  misc_feature (266)..(266): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaanaacaccaggcaaagccccaaactcatcatttangacgtcactcatcggccctcagggtttctactcgcttctctggctccaagtttggcaacacggcctccctgaccatttctgggctccaggctgaggacgaggctgtaattttatgctcctcatatacaggcagcagcacccttatcgtcttcgaactgggaccaaggtccaccgtcacgtcacgcccaagccaacccnctgcactcgtcgttcccacctccncactgactcgactcgngcggtcg

SEQ ID NO: 281000 - DNA, 594 bp, Homo sapiens
  misc_feature: GYAE6OF01CA5VJ.38.38.D05.1.454.CMB.1.raw
  modified_base (272)..(272): a, c, t, g, unknown or other
  misc_feature (272)..(272): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtggttaataactatgtctctggtaccaacaacacccaggacaaaacgccccaaactcatcatttangacgtcactcactcggcctcgtagggtttcctactcgtcttctctggtcctaccgtaagtttggacaacgacggccctcctgtacctattcgtcgggcttccgaggctggacggacgaggtctagtaattttagtcgtcctctactaattactaacgaggactagaccagtccctaacccgtttatcgttccttacggaacgtcgggaacctaggtccaaccgttccgtacgtccgacgacccgaacggacccaacccgtctcgtcctacctcgtccgttccccgcccttcctcgacgttcgactccgatcgcggcggtacg

SEQ ID NO: 281001 - DNA, 557 bp, Homo sapiens
  misc_feature: GYAE6OF01AO8GX.38.38.D05.1.454.CMB.1.raw
  modified_base (269)..(269): a, c, t, g, unknown or other
  misc_feature (269)..(269): n is a, c, g, or t
  modified_base (488)..(488): a, c, t, g, unknown or other
  misc_feature (488)..(488): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggacaaagccccaaactcatcatttangacgtcactcatcggcctcgagggtttcactcgcttctctggctcgaagtttggcacacggcctcctgacctattcgcgggcctccgaggctagaggacgaggctagtaattttatcgctcctcatactacgaggcacgcacgcctaacccttatcgttcttcggaacgtcgggacctaaggtccaccgttcctacgtcacgaccaacggcccaacccnctcgtccaccgtcctccgttaccccacccttccctactaccgtcgtactccgacgtcgaggccgggtcg

SEQ ID NO: 281002 - DNA, 579 bp, Homo sapiens
  misc_feature: GYAE6OF01CGOMT.38.38.D05.1.454.CMB.1.raw
  modified_base (269)..(269): a, c, t, g, unknown or other
  misc_feature (269)..(269): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctctggtaccaacaacacccaggacaaacgccccaaactcatcatttangacgtcactcactcggccctcgaggggtttctactcgcttctctggctcctaagtttcggacaacacggcctccctcgacctatttcgtcggggctccgaggctggacgggacgaggctagtaattttatcgcctcctcatactacgaggacagccacgcctaccccttatcgttacgttaccggaacgtcgggaacctaacggtccaacccgttcctacgtacaccgtcccgaacggccccaacccgctcgtacctacctccgttcgtccccgtccctcctccacgtcgtactcgactcgcggcggtcg

SEQ ID NO: 281003 - DNA, 539 bp, Homo sapiens
  misc_feature: GYAE6OF01CXCBV.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaaactcatcatttatgacgtcactcatcggccctcagggggtttctactcgcttctctggctccaagtttggcaacacggcctccctgaccatttctgggctccagctgaggcgaggctgtaattttatgctcctctatatacagcagcagcctacccttatcgtcttcggaactgggaaccaaggtcaccgtcctacgtcacgcccaacggcccaacccactcgtccactccgtcgttccccgccctcctcctacgtcgtactacgactcggagccgggtacg

SEQ ID NO: 281004 - DNA, 529 bp, Homo sapiens
  misc_feature: GYAE6OF01BRG9P.38.38.D05.1.454.CMB.1.raw
  modified_base (352)..(352): a, c, t, g, unknown or other
  misc_feature (352)..(352): n is a, c, g, or t
  modified_base (479)..(479): a, c, t, g, unknown or other
  misc_feature (479)..(479): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (522)..(522): a, c, t, g, unknown or other
  misc_feature (522)..(522): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttatgacgtcactcatcggccctcaggggtttctactcgcttctctggctccaagtttggcaacacggcctccctgacctatttcngggctccaggctgaggacgaggctgtaattttatgtctcctcatatacaggcagcagcctacccttatcgtcttacggaactgggaccaaggtccaccgtcctacgtcacgcccaaggcccaacccnctcgtcactcgtcgttcccnccctccncacgtgactcgactgngcggtcg

SEQ ID NO: 281005 - DNA, 606 bp, Homo sapiens
  misc_feature: GYAE6OF01E0HM3.38.38.D05.1.454.CMB.1.raw
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctggtctctggacagtcgatcaccatctcctagcactggaagcgagtagtgacagttggtggttataactatgtctcctgtaccaacaacacccaggccaaacgcccccaaactcatcatttatgactcactcagtccggccctcgtagggtttccacgtcgcttctcgtggctccgtaagtttggctaacgaccggtccctccgtgacctagtttcgngggtctccgaggtctggaggaccgnggtctaggtaactttttacgtcgccttcctacaatactacgagacacgcaacgcctaaccctttatcgttccgttacggaacgtcgggaacctaacggtcctacccgtcgtaccgtacacgacccaacgacccaacccgtgtcgtaccaccgttccgtccgttccccgcccttcctaccgtacgttcgtacgtccgacgttcggacgcgggtaccg

SEQ ID NO: 281006 - DNA, 521 bp, Homo sapiens
  misc_feature: GYAE6OF01AL3MD.38.38.D05.1.454.CMB.1.raw
  modified_base (471)..(471): a, c, t, g, unknown or other
  misc_feature (471)..(471): n is a, c, g, or t
  modified_base (513)..(513): a, c, t, g, unknown or other
  misc_feature (513)..(513): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagccaccccttatgtcttcggaactgggaccaaggtcaccgtcctacgtcagcccaaggccaacccnctgtcactctcgttcccgccctcctcacgtcgactcgactgngcgggtcg

SEQ ID NO: 281007 - DNA, 723 bp, Homo sapiens
  misc_feature: GYAE6OF01DMK0T.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttaataactatgtctcctaggtaaccaacaacaccaggcaaaacgccccaaactcatcatttatgacgtcactcactccggccctcgtacggggtttcctacgtccgtcttctcgtcggtctcctaagtttcggacaaccgaccggtccctcctacgacctatttcgtcgggtcctccgacggtcgtaggaacgggacgagggtcttagttaaatttttagttcgtccttcctactaataacgtacgaggtaccacgaccacgtaccctaaccccgtttagttcgttacgttaccgggtaaacgttacggggaacccgtaaggttcccgtaacccgttcccgttaaccggtaccgaaccggtaccccgaaaccggtacccctaaaccccgtaccgttccgtaccctaaccttcccgtttacccgtttaccccccaaccccgttccccgttacccgtaccggttaccgtaaccgttacccggtaacgtcgggtaaccgggcccggggttacccgg

SEQ ID NO: 281008 - DNA, 543 bp, Homo sapiens
  misc_feature: GYAE6OF01E0TZ1.38.38.D05.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (466)..(466): a, c, t, g, unknown or other
  misc_feature (466)..(466): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacacaccaggcaaagccccaaatcatcatttatgacgtcactcatcggccctcgagggtttcactcgcttctctggctctagttggcaacncgcctcctgaccnttcnggctcaggctgagacgngctagtaattttatgctcctnatatacaggcagcagcctacccttatcgtcttcggaactcgggaccaaggtcctaccgtcctacgtcacgacccaacggacccaacccnctcgtaccaccttccgtccgttcccccgcccttccctccgaccgttgtaccttcgaacgtcggacggccgggtacgg

SEQ ID NO: 281009 - DNA, 803 bp, Homo sapiens
  misc_feature: GYAE6OF01DVF7J.38.38.D05.1.454.CMB.1.raw
  modified_base (199)..(199): a, c, t, g, unknown or other
  misc_feature (199)..(199): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtcgtggtctccgtggacagtcgatccaacctatcctcctgccacgtagggaacncgtaggtagtagaactagtttgggttagttaactaacttagtcgttcctccgtacgtaacccaaacaaccaccgaggaaccaaacccgacccctaaactcatctatttatacgtacgtcactctacgtccggtccctacggttacgggtttctaccgttccgtcttcctcgtcgtcctacgtagttacgactaaccgaccgtccctccgtacgtaccttacgttcgtcggcctaccgacggtcgtaggaacgggacgtacggttacgttagtttaagtttttactccgtaccctttcctaacttaagttaacgttacgaacggtaccaacgaccgtaaccgtacccccgttaaccctttaggttccggttacccgtttaccgggaaccgttacgggaacccgttaacggtacccccgtaccgttacccgtaccggtacccaacccggtaccccgaacccggaaccccctaaccctacgttaccgtacccgttaacctttccccgggttccccgttaccccccggtcccccttcccgtaacccggttaccggttaaccgtaccgttacccggaaccgggtcccggtacgggtcccgggtaaccgg

SEQ ID NO: 281010 - DNA, 531 bp, Homo sapiens
  misc_feature: GYAE6OF01CZMIZ.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactgggaagcagtagtgacattggtggttataactatgtctcctggtaccaacaacacccaggcaaagccccaaactcatcatttatgacgtcactcatcggcccctcaggggtttctactcgcttctctggctccaagtttggcaacacggcctccctgaccatttcgtgggctccaggctgaggacgaggctgtattttattgctctcatatacaggcagcagcacccttatgtcttcggaacgtggaccaggtcaccgtcctacgtcacgccctaacggccaaccccactcgtaccacttctcgttcccaccctcctccacgtgtactcgactcggagcgggtccg

SEQ ID NO: 281011 - DNA, 466 bp, Homo sapiens
  misc_feature: GYAE6OF01BHR1S.38.38.D05.1.454.CMB.1.raw
  modified_base (447)..(447): a, c, t, g, unknown or other
  misc_feature (447)..(447): n is a, c, g, or t
  modified_base (453)..(466): a, c, t, g, unknown or other
  misc_feature (453)..(466): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggcctccaggctgaggacgaggctgaattttatgctcctcatatacaggcagcagcaccccttatgtcttcggaactgggaccaaggtcaccgtcctacgtcagcccaaggcccaaccccatcgtcactctcgttccccaccctcctcacgtgactcgactgagcgggctggcaaggcncagtgnnnnnnnnnnnnnn

SEQ ID NO: 281012 - DNA, 530 bp, Homo sapiens
  misc_feature: GYAE6OF01DECWC.38.38.D05.1.454.CMB.1.raw
  modified_base (267)..(267): a, c, t, g, unknown or other
  misc_feature (267)..(267): n is a, c, g, or t
  modified_base (522)..(522): a, c, t, g, unknown or other
  misc_feature (522)..(522): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacacccaggcaaacgccccaaactcatcatttangacgtcactcatcggccctcagggtttctactcgcttctctggctcaagtttgcacacggcctcctgaccatttctgggctccgaggctgaggacgaggctgacttactactgcagttcatatacagcactactctcttctgtatcggcggagggaccgagggtcgaccgtactaagtcagcccaaggcctcgccccgtcgcctacgtcttccgttccccacccttccaccgtaccgtcgtactacgactacggngcgggtcg

SEQ ID NO: 281013 - DNA, 539 bp, Homo sapiens
  misc_feature: GYAE6OF01EO5KA.38.38.D05.1.454.CMB.1.raw
  modified_base (355)..(355): a, c, t, g, unknown or other
  misc_feature (355)..(355): n is a, c, g, or t
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcactcggccctcgaggggtttctactcgcttctctggctcctaagtttcggcaacgacggcctccctgacctatttcngggctccgaggctgaggacgaggctagtaattttatgctcctcatatacaggcagcacgcctacccttatcgtacttcggaactgggaccaaggtccaccgtcctacgtcacgcccaacgcccaacccnctcgtccactctccgttcccaccctcctacncgtcgactcgactggcgcgggtcg

SEQ ID NO: 281014 - DNA, 643 bp, Homo sapiens
  misc_feature: GYAE6OF01CKNL2.38.38.D05.1.454.CMB.1.raw
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (580)..(580): a, c, t, g, unknown or other
  misc_feature (580)..(580): n is a, c, g, or t
tcagtcgatcacgtcacgaccggtgctcgatttagtatctgatagttgggtttgggggcttcgtctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttanaactntgtctcctggtaccaacaacacccaggtacaaacgccccaaactcatcatttaatgacgtcactcacgtccgcctcgagggtttcactcgtcttctctcggctcgtaagtttcggaccaacgaccggcctcccgtcgtacctatttcgtgggtcctccgaggctaggaggtacgaggtcttagtaattttagtcgtaccttcgtactattaacacgagcaagcagccctaccgttatcgtaccgttacgaacgtacggaaccgtaacgtcccgtaccgttaccgtaccggtccgtacgaacccccgtaacggacccctaaaccccgtacgttccgtaccctaccgttccgttccggttcccccnccccgttaccgtacccgtacgttacgtacttaccggtacgtcgggtacggcccgggttaccgg

SEQ ID NO: 281015 - DNA, 695 bp, Homo sapiens
  misc_feature: GYAE6OF01C5PZH.38.38.D05.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctgggtctcctggacagtcgatcaccatctcctgcactggaagcagtagtgactagttggtgttaataaactntgtctccgtaggtaaccaacaaccaccgaggacaaacgtccccaaactcaatcatttatgacgtcactcactccggcctcgtacgggtttctactcgtcttctctcggctctagtttcgcaacacggtcctcctgacctagtttcgtcggcctaccgacggtcgtaggtacggacgtaggtcttagttaagttttattcgtccttacctacgtaattacgtaacgagggtacacgtaccgtagacccttaaccccgtttaagtccggtttaccgttaaccggggtaaccgtacggggtaaaccgtaaccgggttaccctacccgttacccgtaacgttacccgaacccgtacccgaacccggaccccaaaccccgttactaccggttaccctaccgtcccgttacccggttaccccctaccccgttccctaccgtaccgtacgtacgtaccgaccgttacggcggtccggtaccgg

SEQ ID NO: 281016 - DNA, 617 bp, Homo sapiens
  misc_feature: GYAE6OF01CV9IC.38.38.D05.1.454.CMB.1.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcaagtagtgactagtttgggtaggttaataactatgtcctccgtaggtaaccaacaacacccgaggccaaacgccccaaaactcatcatttatgacgtcactcatccgcctcgaggggtttctactcgcttctctgctcagtttggacacgacggcctcctagacctattcgtggctcgagctgaggacgaggctgtaatttatgcctctntatanacagcagcacgcctacccttagtcgtcgttacggaacgtcgggacctaacggtccaccggttacccgtaacgtcgaaccgacccgaacggaccccaaccctaccgttaccgtacctacccgttccttacccgttacccccaccccgtttccctaccgtaaccggttacgtacgttacccggaccgtacggtacgggtccggggtacccgg

SEQ ID NO: 281017 - DNA, 588 bp, Homo sapiens
  misc_feature: GYAE6OF01A1MPB.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctctggtaccaacacaccaggcaaacgccccaaactcatcattatgacgtcactcactcggccctcgaggggtttctactcgtcttctctggctcagtttcgacacacggcctccctgacctattctgggctccaggctggaggacgaggtctagtaattttagtgccttcctcatatacgaggcagcacgcctaccccttatcgttacttcggtaacgtcgggaccaacgggtccaaccgttccgtacgtcacgacccgaacgaccccaaccccgtactccgtcctacccgttcgttcccggttccccgccccttcccgtaccgtaccggtcgtacgttcccgtactcggaacggtccgggtaccgg

SEQ ID NO: 281018 - DNA, 548 bp, Homo sapiens
  misc_feature: GYAE6OF01D7XDJ.38.38.D05.1.454.CMB.1.raw
  modified_base (395)..(395): a, c, t, g, unknown or other
  misc_feature (395)..(395): n is a, c, g, or t
  modified_base (539)..(539): a, c, t, g, unknown or other
  misc_feature (539)..(539): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaatcatcatttatgacgtcactcatcggccctcaggggtttctactcgcttctctggctcctaagtttggacaacacggcctccctgacctatttctgggctccaggctgaggacgaggctgtaattttatcgctcctnatatacaggcagcagcctaccctttatcgttcttacggaactgggacctaagggtccaccggttcctacgtccacgacccaacggacccaacccactcgtccacttccgtcgttccccgcccttcctcacgtgactcgactcgnggcgggtcg

SEQ ID NO: 281019 - DNA, 617 bp, Homo sapiens
  misc_feature: GYAE6OF01DQMGY.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagtttggtgttaataactatgtctcctaggtaaccaacaacacccaggcaaaacgcccccaaactcatctatttatgacgtcactcactccggccctcgtacgggtttctactcgcttctcgtggtctctaagtttcgacaaccgaccggtccctccgtacgtacctagtttcgtcgggctccgaggtctggaggacgaggtcttagtaattttatgcttcctatatatacgagtcagcacgcctacccttatccgttcgttaccggaacgtcggaacctaacggtccacccgtccgtacgtaccaccgacccgaaccggacccaacccctacgtcgtacctaccttccgttcccgttaccccgtcccttccctaccgtaccgttcgtacttccgagtccggacggccgggtaccgg

SEQ ID NO: 281020 - DNA, 616 bp, Homo sapiens
  misc_feature: GYAE6OF01EGD21.38.38.D05.1.454.CMB.1.raw
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (605)..(605): a, c, t, g, unknown or other
  misc_feature (605)..(605): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacacaccaggcaaacgccccaaactcatcatttatgacgtcactcactcggccccttnaggggtttctaccttcgcctttctcgtcggctaccgtaagtttggacaacaccggccctccctcgacctattttcgngggctccaggctggaggacgaggctagtattttatgtctcctcaatatacaggtcagcacgtcctaccctttatcgttccgttacggaaccgttcggggaacctaacgggtccctaacccgttcccgtaccgttaccacgacccgaacggacccctaaccccgacgtcgtacctaaccttccgtaccgtttcccccacccttcccgtacctaccgttacgtacgtaccgaaccttcggngccgggtaccg

SEQ ID NO: 281021 - DNA, 460 bp, Homo sapiens
  misc_feature: GYAE6OF01AYOC5.38.38.D05.1.454.CMB.1.raw
  modified_base (307)..(307): a, c, t, g, unknown or other
  misc_feature (307)..(307): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
  modified_base (453)..(460): a, c, t, g, unknown or other
  misc_feature (453)..(460): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctnatatacaggcagcagccaccccttatgtcttcggaactggaccaaggtcaccgtctacgtcacgcccaaggcccaaccccactcgtccactctcgttccccgccctcctcacgtnactccgactgacgcggctggcaggcncatgnnnnnnnn

SEQ ID NO: 281022 - DNA, 542 bp, Homo sapiens
  misc_feature: GYAE6OF01BGDYV.38.38.D05.1.454.CMB.1.raw
  modified_base (345)..(345): a, c, t, g, unknown or other
  misc_feature (345)..(345): n is a, c, g, or t
  modified_base (479)..(479): a, c, t, g, unknown or other
  misc_feature (479)..(479): n is a, c, g, or t
  modified_base (508)..(508): a, c, t, g, unknown or other
  misc_feature (508)..(508): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaagccccaaactcatcatttatgacgtcactcatcggcctcgagggtttctactcgcttctctggctccaagtttgcaacacggcctcctgaccatttcngggctccaggctgaggacgaggctagtaattttatgtctcctcatatacaggcagcacgcctacccttatcgtcttacggaacgtcgggaccaggtccaccgtcctacgtcacgacccgaacggcccaaccctntcgtcacctctccgttccccacccttccnccgtacgtcgtactaccgatcgcggccgggtacg

SEQ ID NO: 281023 - DNA, 723 bp, Homo sapiens
  misc_feature: GYAE6OF01BY4KD.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttaataactatgtctcctaggtaaccaaacaaccacccgaggaccaaaacgcccccaaactcatcatttatgacgtcactcactcggcctcgtacgggtttctactcgtcttctcgtcggtctaccgtaagtttcggaccaaccgaccggccctcccgtcgtaaccttacgtttccgtcgggccttcgacggtctaggaacgggacgaggtacttaggttaaactttttacgtcgtccttacctactaattaacgtaacgacgacaacgccaacgtaccctaaccccgtttatcgttaccgttacgggaacgttacgggaacccgtaacggttccctaacccggttccccgttaaccggtaccaaccggtacccccgaaacgggaacccccctaaaccccgtacgttaccggttaccctaaccgttcccgttcccgttaccccccacccctttcccgtacccgtaaccgttacggtacctacccggtaaccgtcgggaccgtcccggggtaccgg

SEQ ID NO: 281024 - DNA, 534 bp, Homo sapiens
  misc_feature: GYAE6OF01CDHX2.38.38.D05.1.454.CMB.1.raw
  modified_base (269)..(269): a, c, t, g, unknown or other
  misc_feature (269)..(269): n is a, c, g, or t
  modified_base (330)..(330): a, c, t, g, unknown or other
  misc_feature (330)..(330): n is a, c, g, or t
  modified_base (511)..(511): a, c, t, g, unknown or other
  misc_feature (511)..(511): n is a, c, g, or t
  modified_base (527)..(527): a, c, t, g, unknown or other
  misc_feature (527)..(527): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcatcattttangacgtcactcatccggccctcaggggtttctactcgcttctctggctcaagtttggcaacncggcctcctgacctatttctgggctccgaggctgaggacgaggctgtaattttattgctcctcatatacaggcagcacgcctaaccccttatcgtacttcggaactgggaaccaaggtccaccgtcctacgtcacgcccaaggcccaacccgactcgtccactcctcgttccccacctccncacgtgactcgactgngcggtcg

SEQ ID NO: 281025 - DNA, 463 bp, Homo sapiens
  misc_feature: GYAE6OF01A3C5V.38.38.D05.1.454.CMB.1.raw
  modified_base (452)..(463): a, c, t, g, unknown or other
  misc_feature (452)..(463): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcagcccaaaggcccaaaccccactgtcactctgttccccgccctcctcacgtgatcgactgagcgggctggcaaggcgcatagnnnnnnnnnnnn

SEQ ID NO: 281026 - DNA, 584 bp, Homo sapiens
  misc_feature: GYAE6OF01EF21W.38.38.D05.1.454.CMB.1.raw
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacgcccaggacaaacgccccaaatcatcatttatgacgtcactcatccggccctcgtaggggtttctactcgtcttctcgtggcctcctaagtttggacaacgaccggcctccctgacctatttcgtgggcctccgaggctaggaggacgaggctagtaattttntgctcctnatatacgaggcagcacgtcctaccctttagtcgtcgttacggaactcgggaaccaaggtccaccgtctacgtcacgacccaacggacccaaccctctcgtacctacttccgtccgttccccgccccttccgtaccgtacgtacgtactacggaccgttcggcgggtccgggtaccgg

SEQ ID NO: 281027 - DNA, 718 bp, Homo sapiens
  misc_feature: GYAE6OF01ARFQ7.38.38.D05.1.454.CMB.1.raw
  modified_base (140)..(140): a, c, t, g, unknown or other
  misc_feature (140)..(140): n is a, c, g, or t
  modified_base (181)..(181): a, c, t, g, unknown or other
  misc_feature (181)..(181): n is a, c, g, or t
tcagtcgatcacgtcacgaccggtgctcgatttagtatctgatagttgggtttgggggctttaggccctagggctcctgcgtgctccctcaccctcctcactcaggcaccagggtcctgggcccagtctgccctgtactnagcctgcctcgtgtctgggtctcctggacagtcgatcaccntctcctgcactggaagcagtagtgactagttgggtgttaataacgtatcgtcctcctaggtaaccaacaacacccgaggtacaaaaccgtcccccaaacttcctactactaatttatagtacgtcactcacgtccggtcccgtacggtacgggtttctacgtcgtcttcgtcgtcggtctaccgtaaggttcgacctaacgtaccggtacctaccgtacgtacctagtttcggtacggtacctcgaggtctacggacggtacgacggtactagttactttcgtcgacctctactagtactacgacgtacacgtacacgtaccctaaccgttgtcgttacgtacggaacgtacggtaaccgtacggtacctaaccgtccgtaacgtccgaaccgtacccgtaaccggacccctaacccgtcgtaccggttaccctaccgtttaccgttaccccgttacccccgtacccgttacccgttaccgtaccgttacggtaaccgttacccggacggtttcgggaccgggtccgggtacccggg

SEQ ID NO: 281028 - DNA, 667 bp, Homo sapiens
  misc_feature: GYAE6OF01BRH2K.38.38.D05.1.454.CMB.1.raw
  modified_base (588)..(588): a, c, t, g, unknown or other
  misc_feature (588)..(588): n is a, c, g, or t
  modified_base (642)..(642): a, c, t, g, unknown or other
  misc_feature (642)..(642): n is a, c, g, or t
  modified_base (644)..(650): a, c, t, g, unknown or other
  misc_feature (644)..(650): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
  modified_base (657)..(667): a, c, t, g, unknown or other
  misc_feature (657)..(667): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtcacaacaccacgagacaaccgacccaatcatctatttgacgtactactactctacgtccgcctggttacggttactacgtcgtcttctcgtacgtcctacgttagttcgaccaacgccgtcctcgacacttactttcggcggtcctcgagtcgtaggacggacgacgtcgtaagtttaattttgtctccttcctataacgtaactacggcggtacacgaccgtaccgaccttacccgtttagtacgtttaccggttaaccggtaacggtaccgggtaaaccgtaccggttacccgtacccggtttaacccgtaaccgtaccgaacccgtaacccggaacccggtaacccctaaacccccgtgttaccgtacccttaccgtttcccgtttacccggtccccccgtccccttaccgtacggtacgtacgttaccgacgttaacgngggtaaccgggtcccggtcgtaccgggacgtacgggctaactaagcgctgcagncnnnnnnncncnncnnnnnnnnnnn

SEQ ID NO: 281029 - DNA, 472 bp, Homo sapiens
  misc_feature: GYAE6OF01DDUUZ.38.38.D05.1.454.CMB.1.raw
  modified_base (459)..(460): a, c, t, g, unknown or other
  misc_feature (459)..(460): n is a, c, g, or t
  modified_base (462)..(472): a, c, t, g, unknown or other
  misc_feature (462)..(472): n is a, c, g, or t
tcagtcgatcacgtcacgaccggtgctcgatttagtatctgatagttgagtttgggggctttgtctgggtctcctggacagtcgatcaccatctccggggtgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcacgcccaaggcccaaccccactgtcactctcgttccccaccctcctcacgtgatccgactgacgcgggctggcaaggcgcatagnngnnnnnnnnnnn

SEQ ID NO: 281030 - DNA, 302 bp, Homo sapiens
  misc_feature: GYAE6OF01BHPAH.38.38.D05.1.454.CMB.1.raw
  modified_base (294)..(302): a, c, t, g, unknown or other
  misc_feature (294)..(302): n is a, c, g, or t
tcagtcgatcacgtcacgaccggtgctcgatttagtatctgatagttgggtttggggtttcgtactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcagcccaaggccaacccactgtcactctcgttcccgcctctcacgtgatcgactgagtcgggctggcaaggcgcatagnnnnnnnnn

SEQ ID NO: 281031 - DNA, 711 bp, Homo sapiens
  misc_feature: GYAE6OF01DLMPA.38.38.D05.1.454.CMB.1.raw
  modified_base (278)..(278): a, c, t, g, unknown or other
  misc_feature (278)..(278): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttgggtagttaataactatgtctcctaggtaccaaacaacacccgaggacaaacgaccccaaactcatcatttancgacgtcactcactccggccctcgtacggggtttctacgtcgtcttctcgtcggcctaccgtaagtttcggaccaaccgaccggtccctaccgtcgtacccttatttccgtcgggtccctaccgaggtcgtaggaacgggacggtaggtacttaggttaaatttttgttcgtccttacctactaattacgtacgaggaccagaccacgtaccctacccgtttagttacgttacgttaaccgggtaacgtaccggggaaccctaacgggttccctaacccggttacccgttaaccggtccaaccggaccccgtaaaccggcccccaaaccctacgttccgtaccctaccgttcccgttacccggtccccccgtaccccttcccgtaccgtacggttaccgtacgttacgtccgtacggcgggtaccgggtccgg

SEQ ID NO: 281032 - DNA, 544 bp, Homo sapiens
  misc_feature: GYAE6OF01CC0TI.38.38.D05.1.454.CMB.1.raw
  modified_base (269)..(269): a, c, t, g, unknown or other
  misc_feature (269)..(269): n is a, c, g, or t
  modified_base (386)..(386): a, c, t, g, unknown or other
  misc_feature (386)..(386): n is a, c, g, or t
  modified_base (476)..(476): a, c, t, g, unknown or other
  misc_feature (476)..(476): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaaacgccccaaactcatcatttangacgtcactcatcggcctctaggggtttctactcgcttctctgctccaagtttggcacacggcctcctgacctattctcggctccaggctgaggcgaggctgtatttatgctcctanatatacaggcaagcagcctacccttatcgtcgttacggaactcgggacctaaggtcaccgtccgtacgtcacgtacccaagcccaacccntcgtacacttcctcgttaccccacccttccctactacgtctactaccgacgtcggaggtcgggtaccg

SEQ ID NO: 281033 - DNA, 296 bp, Homo sapiens
  misc_feature: GYAE6OF01B9IZI.38.38.D05.1.454.CMB.1.raw
  modified_base (284)..(284): a, c, t, g, unknown or other
  misc_feature (284)..(284): n is a, c, g, or t
  modified_base (290)..(296): a, c, t, g, unknown or other
  misc_feature (290)..(296): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagccaccccttatgtcttcggaactgggaccaaggtcaccgtcctacgtcagcccaaggccaaccccactgtcactctgttccccaccctcctcacgtgatcgactgagcgggctggcaaggcncatagnnnnnnn

SEQ ID NO: 281034 - DNA, 511 bp, Homo sapiens
  misc_feature: GYAE6OF01A7301.38.38.D05.1.454.CMB.1.raw
  modified_base (267)..(267): a, c, t, g, unknown or other
  misc_feature (267)..(267): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (461)..(461): a, c, t, g, unknown or other
  misc_feature (461)..(461): n is a, c, g, or t
  modified_base (504)..(504): a, c, t, g, unknown or other
  misc_feature (504)..(504): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaagcccccaaatcatcatttangacgtcactcatcggccctcagggtttctactcgcttctctggctccaagtttggcaacacggcctccctgacctatttcngggctccaggctgacggacgagctgattttatgctctcatatacaggcagcancctacccttncgtcttcgaactggaccaaggtcaccgtccagtcagcccacgccaacccntcgtacactcgtcgttaccccacctcctcacgtcgactcatgngtcggcg

SEQ ID NO: 281035 - DNA, 596 bp, Homo sapiens
  misc_feature: GYAE6OF01ACMSF.38.38.D05.1.454.CMB.1.raw
  modified_base (374)..(374): a, c, t, g, unknown or other
  misc_feature (374)..(374): n is a, c, g, or t
  modified_base (452)..(452): a, c, t, g, unknown or other
  misc_feature (452)..(452): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacaggtcgagtcaccatctcctgcgactggaagcagtacgtgactattgggtgttaataacgtatgtaccttccgtaggtaaccaaacaacacccgaaggcaaaacgcccccaaatccatcatttatgacggtcactcagtcggccctcgtaggggtttctactcgcttcgtcgtggctacaagtttggacaacacgcctccctggacctattcngggcctccaggctaggacggacgaggctagaacttttagtgacttcctgtactaatacaggcagcagccacccgttancgtacttcggaacgtggaccaagtccgaaccgtccgtacgtcaacgcccaacggacccaacccgtctcgtacaacccgtctaccgttaccccacccgttccgaccgtacgttcgaccgtccgtactcggaacggccgggtaccg

SEQ ID NO: 281036 - DNA, 787 bp, Homo sapiens
  misc_feature: GYAE6OF01COE6Y.38.38.D05.1.454.CMB.1.raw
  modified_base (221)..(221): a, c, t, g, unknown or other
  misc_feature (221)..(221): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgactagttgggtgttaataactntgtctcgtggtaaccaacaaccaccgaggacaaaccgaccccaaactcatctatttatgacgtcactcactccggcctcgtacgggtttctactcgtcttctcgtgtctacgtagtttcgacaacgacggtccctcctacgaccttagtttccgtcgggtcctccgacggtcgtaggaacgggacggtacgggtacgttaggtttaaactttttacgttcggtaccctttaccgttactaacgtttaacgtaaccggtaacgggtaccgaacggtaccacggtaccccttaacccccgttttagttccggttaccgtttaaccgggaaaccgttacggggaaaccccgttaacgggttcccctaaccggtttccccgttaaaccggtacccaacccgggtaaccccgtaaacccgggtaccccctaaaacccccggtactttacccggtaccccgttaaccgtttccccggtttaccccgtttccccccgtacccctttcccgttacccgtaccggttacgtaccgttacccggtacggtacgggaccgggtccggggtacccggg

SEQ ID NO: 281037 - DNA, 507 bp, Homo sapiens
  misc_feature: GYAE6OF01BYOND.38.38.D05.1.454.CMB.1.raw
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
  modified_base (466)..(467): a, c, t, g, unknown or other
  misc_feature (466)..(467): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (479)..(480): a, c, t, g, unknown or other
  misc_feature (479)..(480): n is a, c, g, or t
  modified_base (483)..(485): a, c, t, g, unknown or other
  misc_feature (483)..(485): n is a, c, g, or t
  modified_base (488)..(490): a, c, t, g, unknown or other
  misc_feature (488)..(490): n is a, c, g, or t
  modified_base (492)..(494): a, c, t, g, unknown or other
  misc_feature (492)..(494): n is a, c, g, or t
  modified_base (498)..(498): a, c, t, g, unknown or other
  misc_feature (498)..(498): n is a, c, g, or t
  modified_base (500)..(501): a, c, t, g, unknown or other
  misc_feature (500)..(501): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
tcagtcgatcacgtcacgaccggtgctcgatttagtatctgatagttggggtttgggggctttgtctgggtctcctggacagtcgatcaccatctcctcgcactggaagcaggtagtgacattggtggttataactatgtctcctggtaccaacaacacccaggcaaagcccccaaatcatcatttatgacgtcactcatcggccctcgaggggtttcactcgcttctctggctccaagtttggcaacacggcctccctgaccatttcngggcctccgaggctgaggacgacggctgaattttatgcttcctnatatacaggcaggcagctaccccttatgtcttcggaactggaccaaggtcaccggtcctacgtcacgccctaaggcccaaccccntcgtcactctgttccccacctcctcacgtnactcgactgagcggctggcaaggcgacagtagngtacnncgnacgngacannacnnngcnnncnnnctcncnncncnnc

SEQ ID NO: 281038 - DNA, 609 bp, Homo sapiens
  misc_feature: GYAE6OF01C4CS2.38.38.D05.1.454.CMB.1.raw
tcagtcgatcacgtcacgaccggtgctcgatttagtatctgatagttggggtttgggggctttgcctgggctctgctgctcctcacctcctcactcagggcacagggtcctgggcccagtctgccctgactcagcctgcctccgtgtctgggtctcctggacagtcgatcaccatctcctgcactggaagcagtagtgactagttggtggttaataactatgtctccgtggtaccaacaacacccaggcaaacgcccccaaaactcatcatttatgacgtcactcatcggccctcgtaggggtttctacgtcgtcttcgtctggtactaccgtaagtttggactaaccaccggaccctcctacgtacctactttccgagggcctaccgaggtctcggaggacgaggcttagtaattttattgccttacctcgtaattacgactaggcaagcacgccacccttatcgtctacgaacgtcggacctaaggtccaccgtcctacgtcgacgacccgaacggccaaccccgtactacgcctaaccgtccgttcgttaccctcggtccccttcccttactacgttcgaacgttcccgacgtggacggtcccggg

SEQ ID NO: 281039 - DNA, 657 bp, Homo sapiens
  misc_feature: GYAE6OF01BXFRC.38.38.D05.1.454.CMB.1.raw
  modified_base (376)..(376): a, c, t, g, unknown or other
  misc_feature (376)..(376): n is a, c, g, or t
  modified_base (440)..(440): a, c, t, g, unknown or other
  misc_feature (440)..(440): n is a, c, g, or t
  modified_base (549)..(549): a, c, t, g, unknown or other
  misc_feature (549)..(549): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtcctcctggacagtcgatcaccatctcctgcactggaagcagtagtgacattggtgttataactatcgtctcctggtaccaacaaccacccgaggacaaacgaccccaaactcatctatttatgactcactcacgtccggccctcgtacgggtttctactcgtcttctcgtcggctctaagttcgacacaccggtcctcctacgacctattcgtcggcctccgnggtctggacggacgacggtcgtagttaattttacgtgtaccttcctactatactacgaggtacngacacgcctaccccgtttatcgttccgtaccggtaacgtcgggaaccctaaggtcccaacccggttcctaccgtacgaccgtaccccgaacggtaccccaaaccccgtnttaccggtacctacccgttacccgtttcccgttaccccctaccccttcccttaccggtacccggttagtacccgttacccgacggtacggtacgggcccgggtaccgg

SEQ ID NO: 281040 - DNA, 560 bp, Homo sapiens
  misc_feature: GYAE6OF01AG6UC.38.38.D05.1.454.CMB.1.raw
  modified_base (190)..(190): a, c, t, g, unknown or other
  misc_feature (190)..(190): n is a, c, g, or t
  modified_base (386)..(386): a, c, t, g, unknown or other
  misc_feature (386)..(386): n is a, c, g, or t
  modified_base (488)..(488): a, c, t, g, unknown or other
  misc_feature (488)..(488): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttaataactatgtctcctggtaccaacaaccacccaggcaaacgcccccaaactcatcatttatgacgtcactcatcggcccctcgaggggttttcactcgcttctctggctcaagttggcaacacggcctccctgacctatttctggctccaggctgaggacgaggctgtaatttttntgcctcctctatactacaggcagcacgctaccccttatcgttcttacggaactggaccaacggtccaccgtcctacgtaccacgcccaacggacccaacccntcgtccactcccgttacgttcccccgcccttcctccgacgttcgacgttcgacttggaccggcgggtaccgg

SEQ ID NO: 281041 - DNA, 297 bp, Homo sapiens
  misc_feature: GYAE6OF01A0XJC.38.38.D05.1.454.CMB.1.raw
  modified_base (288)..(297): a, c, t, g, unknown or other
  misc_feature (288)..(297): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccgccctcctcacgtgatcgactgagcgggctggcaaggcgcatagnnnnnnnnnn

SEQ ID NO: 281042 - DNA, 772 bp, Homo sapiens
  misc_feature: GYAE6OF01DLS6I.38.38.D05.1.454.CMB.1.raw
  modified_base (722)..(722): a, c, t, g, unknown or other
  misc_feature (722)..(722): n is a, c, g, or t
  modified_base (731)..(731): a, c, t, g, unknown or other
  misc_feature (731)..(731): n is a, c, g, or t
  modified_base (748)..(748): a, c, t, g, unknown or other
  misc_feature (748)..(748): n is a, c, g, or t
  modified_base (758)..(758): a, c, t, g, unknown or other
  misc_feature (758)..(758): n is a, c, g, or t
  modified_base (764)..(765): a, c, t, g, unknown or other
  misc_feature (764)..(765): n is a, c, g, or t
  modified_base (771)..(771): a, c, t, g, unknown or other
  misc_feature (771)..(771): n is a, c, g, or t
tcagtcgatcacgtcacgaccggtgctcgatttagtatctgatagttgggtagggtttgggggtctttgtctgggtcgtcctggacagtcgatcaccatctcctggcactcggaacgctacgtacgtccgtacacttggttgttagtaactatggtctcgtggtacaacaacaccaggcaagcccaaactcatccatttatgacgtcactcagtcggacctcgagggttctactcgtctctcgtggctacctaagtttgacgtaacaacggtaccttacctcggtaccttaattttccgtcgggtacctaccgtaaacggtccgttaacggaacgggtaacccggaacggtaccgttaacggttaaaacggtttttaactttcggttaccgttaccttcgtaaacgttaacctaaccggtacggggacctaacggtaacgtaaaccggtcccttaaccccgttaacgttcgttaccgtttaccgggtaaccttacgggggtaaaccccgtaacgggttacccggtaacccggtttcccgtaaacccggtaccgtaacccggttaccccggaaaccgggtacccccgtaaaacccctaacggtttccgtaaccgtaccgtttacccgtacccggttaccccgaaccctttccgtacggttaccgtagtactccgtaacgttcgacggtacggctcgggactacggctacgatacgtctgtagnacggtgacnggacttgcgtgcaggtnactcgatccnctcacnnctcgcnc

SEQ ID NO: 281043 - DNA, 544 bp, Homo sapiens
  misc_feature: GYAE6OF01DNXMB.38.38.D05.1.454.CMB.1.raw
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (522)..(523): a, c, t, g, unknown or other
  misc_feature (522)..(523): n is a, c, g, or t
  modified_base (528)..(530): a, c, t, g, unknown or other
  misc_feature (528)..(530): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(543): a, c, t, g, unknown or other
  misc_feature (537)..(543): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaacgcccccaaactcatcatttatgacgtcactcatccggcctcaggggtttctactcgcttctctggctcctaagtttggacaacacggcctccctgacctatttcgtgggctccgaggctgaggacgagctagtaattttatgctctnatatacgaggcagcagcctacccttntcgtcgttacgaacgtcggaaccaaggtccaccgttacctacgtccacgtacccaacggaccccaaaccccgtacttcgacctactccgttccgttccccgccctcctacgaccgtgtaacttcggctcggacggtccggcgtcggacgaacggtcgactagtagcagcgagntnangcncanngcgcnnncnncncnnnnnnnc

SEQ ID NO: 281044 - DNA, 517 bp, Homo sapiens
  misc_feature: GYAE6OF01EEMJA.38.38.D05.1.454.CMB.1.raw
  modified_base (344)..(344): a, c, t, g, unknown or other
  misc_feature (344)..(344): n is a, c, g, or t
  modified_base (466)..(466): a, c, t, g, unknown or other
  misc_feature (466)..(466): n is a, c, g, or t
  modified_base (485)..(485): a, c, t, g, unknown or other
  misc_feature (485)..(485): n is a, c, g, or t
  modified_base (511)..(511): a, c, t, g, unknown or other
  misc_feature (511)..(511): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaagccccaaactcatcatttatgacgtcactcatcggccctcaggggtttcactcgcttctctggctccaagtttgcaacacggcctcctgacatttcnggctcaggctgaggacgaggctgtaattttatgctctcatatacaggcagcagcctacccttatgtcgtcgaacgtcgggaccaaggtccaccgtcctacgtccagcccaaggcccaacccntcgtcactcgtcgttcccncctcctcacgtcgactccgatcgcgngggtcg

SEQ ID NO: 281045 - DNA, 566 bp, Homo sapiens
  misc_feature: GYAE6OF01ETIWR.38.38.D05.1.454.CMB.1.raw
  modified_base (355)..(355): a, c, t, g, unknown or other
  misc_feature (355)..(355): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacacaccaggcaaaagccccaaactcatcatttatgacgtcactcatccggccctcgtaggggtttcctactcgtcttctctcggctcctaagtttggacaacaccggcctccctgaccatttcngggtctccaggctgaggacgaggctgtaaattttattcgactcctatatatacgaggcaacgtcaacgtcctaccccttaatcgttacgtacggaactgggaacctaagggtccaccgtcctacgtcacgacccaacggccctaacccactcgtaccactctccgttacccgccctccgtcacgtacgtactacgacgtcgaggcggtacg

SEQ ID NO: 281046 - DNA, 584 bp, Homo sapiens
  misc_feature: GYAE6OF01C8A0Q.38.38.D05.1.454.CMB.1.raw
  modified_base (572)..(572): a, c, t, g, unknown or other
  misc_feature (572)..(572): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcaagtagtgacattggtaggttataactatgtctcctggtaccaacaacaccaggcaaacgccccaaactcatcatttatgacgtcactcatcggcctgtaggggtttctactcgtcttctctcggctccaagtttcggacaacgacggccctcctcgacctatttctgggctccaggctgaggacgagctgtaattttattcgctcctcatatacagcaacgcacgacctaccccttattcgtcgtttaccggtaacgtacgggaccgtaacggtaccaacccggttcctacgtctacggacccaacgcccaacccctactacgtcctactcctaccgttccccgtcccctccctacctacgtacgtacctacgactcggnggccggtaccgg

SEQ ID NO: 281047 - DNA, 861 bp, Homo sapiens
  misc_feature: GYAE6OF01CVM4F.38.38.D05.1.454.CMB.1.raw
  modified_base (218)..(218): a, c, t, g, unknown or other
  misc_feature (218)..(218): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcaggtagtgacattggtggttataactntgtctcctggtaccaacaacaccgaggcaaacgccccaaactcatcatttatgacgtcactcatcggcctcgagggtttctactcgcttctctggctccaagtttgacaaccacgggtcctccctacgtacctaacgttttccgtcggggtccttacccgaacgggtccgttagggaacggggtaaccggaacggggtacctttaggtttaaaaacttttttagtttacggtcctttaccccttactaacctttaaagttaaccgtaacgggtactaacgggtaccaacgggtacccctttaaaccccccgttttaaagtttcgggtttaccccgttttaacgggggtaaacccgtttaacggggggaaacccccgttaaaacgggggttaacccgttaacccccggtttaacccgttaaacccgggtttcctaaacccgggtacccccaaaacgggggtacccccctaaaaacccccctaccgtttaccggttacccctaaacccgtttccccgttttaacccgggttttacccccccggtcccccgtttacccccttacccggttaaacccggttacggttaaacccgttaacccggtaaccggttttacgggaaaccggggtcccccggggggttaacgg

SEQ ID NO: 281048 - DNA, 734 bp, Homo sapiens
  misc_feature: GYAE6OF01COVRL.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgactagttggtagttaataactatgtctccgtaggtaaccaacaaccacccgaggacaaaaccgaccccaaatccatactatttatcgacgtcactcacgtccggccctcgtacggggtttctactcgtcttctcgtcggctcctaagtttcggactaacgaccggccctcctcgacctagtttcgtcgggtctccgaggtcgtggtaaggacgtacggtacttagttaattttcttacgtccttccctactaacgttactaacgaacggtacgtacgtaccgtacggtacccctaacccgtttagttaccgttacccgtttaaccggtaaccggttacgggaaacccgtaacgggttacccaaccccggtttacccgttaaccgtaccgtaccggaaccccgtaaccgggacccccaaaccccgtaccgttacgtaccctacgttacccgtttaccgttaccccccgtaccccttacccgttacccgaacgttacgtaccttacccggattcggggacgtcccggggttaaccgg

SEQ ID NO: 281049 - DNA, 563 bp, Homo sapiens
  misc_feature: GYAE6OF01BXPO2.38.38.D05.1.454.CMB.1.raw
  modified_base (494)..(494): a, c, t, g, unknown or other
  misc_feature (494)..(494): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggcccctcaggggtttctactcgcttctctgctccagtttgcaacacggcctccctgaccatttctgggctccaggctggaggacgaggctagtaaatttttatcgtcttcctctatactacgaggcagcacgcctaccccttatcgtccttacggaacgtcgggaaccaaggtccaccgtccctacgtccacgacccaacggcccaacccncgtcgtaccacttccgttcgttccccgccccttcctccacgtcgacgtcacgtcggacggcggtaccgg

SEQ ID NO: 281050 - DNA, 312 bp, Homo sapiens
  misc_feature: GYAE6OF01A3RHO.38.38.D05.1.454.CMB.1.raw
  modified_base (157)..(157): a, c, t, g, unknown or other
  misc_feature (157)..(157): n is a, c, g, or t
  modified_base (237)..(237): a, c, t, g, unknown or other
  misc_feature (237)..(237): n is a, c, g, or t
  modified_base (290)..(290): a, c, t, g, unknown or other
  misc_feature (290)..(290): n is a, c, g, or t
  modified_base (295)..(312): a, c, t, g, unknown or other
  misc_feature (295)..(312): n is a, c, g, or t
tcagtcgatcacgtcacgaccggtgctcgatttagtatctgatagttggggtttggggtttctactcgcttctctggctccaagtttggcaacaccggcctccctgaccatttctgggcctccaggctgaggacgaggctgaattttattgctcctnatatacaggcagcagccaccccttatgtcttcggaactgggaccaggtcaccgtcctacgtcagcccaaggccaaccccntgtcactctcgttcccacctctcacgtgactcgactgagcggctggcaaggcncatgnnnnnnnnnnnnnnnnnn

SEQ ID NO: 281051 - DNA, 519 bp, Homo sapiens
  misc_feature: GYAE6OF01C163I.38.38.D05.1.454.CMB.1.raw
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaagccccaaatcatcatttatgacgtcactcatcggcctcaggggtttctactcgcttctctgctccaagtttggcaacacggcctcctgacctatttcgtgggctcgaggctgagacgagctgtaatttatgctctnatatacaggcagcagcacccttancgtcttcggactgggaccaaggtcaccgtctacgtcacgcccaaggcccaacccgatcgtaccacttccgtcgttccccnccttcctcgacgtgactcgacttgngcggtcg

SEQ ID NO: 281052 - DNA, 554 bp, Homo sapiens
  misc_feature: GYAE6OF01E2W7B.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaaacaacacccaggcaaacgcccccaaaactcatcatttatgacgtcactcatccggccctcgaggggttttctactcgcttctctggctccaagtttggcaacacggcctccctgacctatttctgggcctccgaggctggaggacgaggtctgtaatttttatcgctcctacatatacaggcagcacgcctaccccttatcgtcgttcggaactcgggaccaaggtccaccgtcctacgtcacgacccaacggacccaaccccactcgtccacttcctccgttccccaccctcctcacgtcgtactcgactggcgcggtcg

SEQ ID NO: 281053 - DNA, 481 bp, Homo sapiens
  misc_feature: GYAE6OF01A1MQU.38.38.D05.1.454.CMB.1.raw
  modified_base (312)..(312): a, c, t, g, unknown or other
  misc_feature (312)..(312): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (461)..(481): a, c, t, g, unknown or other
  misc_feature (461)..(481): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccgaggctgaggacgaggctgaattttatgctcctcatanacaggcagcacgcctaccccttatcgtcgttcggaacgtgggaccaaggtccaccgtcctacgtcacgcccaacggccaacccactcgtcactctcgtccccnccctcctcacgtcactcgactggacgcggctggcaaggcncacngnnnnnnnnnnnnnnnnnnnnn

SEQ ID NO: 281054 - DNA, 539 bp, Homo sapiens
  misc_feature: GYAE6OF01B4024.38.38.D05.1.454.CMB.1.raw
  modified_base (400)..(400): a, c, t, g, unknown or other
  misc_feature (400)..(400): n is a, c, g, or t
  modified_base (476)..(476): a, c, t, g, unknown or other
  misc_feature (476)..(476): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaaccaacaacacccaggcaaacgccccaaactcatcatttatgacgtcactcatccgcctcaggggtttctactcgcttctctggctccaagtttcggacaacaccggccctcctgacctatttcgtggctcaggctgaggacgaggctgtaatttatgctcctcatatacngcagcagccacccttatcgtcttcgaactggaccaaggtcctaccgtcctacgtcacgacccaagccccaaacccntacgcctaactcgtcgttaccccacccttccctcaaccgtgactcgacctggacggcggtacg

SEQ ID NO: 281055 - DNA, 739 bp, Homo sapiens
  misc_feature: GYAE6OF01ATMNV.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtgttaataactatgtctcctagtaccaacaacaccaggaccaaacgcccccaaactcatcatttatgacgtcactcatccggccctactaggggtttctactcgcttctctggtctacctagtttggacacaccggcctccctgacctatttcgtgggtcctccgaggtctggacggacgacggtcttacggtaaatttttacgttcgtaccttcccgtactaagtttaactaaccgtagggtaccaacgacccgtaacggtacccctaacccccgtttacttaccggttacccgtttaccgggtaaacccgttacggggaaacccgtaaacgggttaccccgtaacccgttacccgttaacccgtaccgaaccggaacccccgaaccgggtaaccccccaaacccccgtaacccgttaccgtaccctaacccgttcccgtttacccggtttacccccggtccccttaccccgttccgtacccggtacgtaaccgtcccggtaacggtccggaccgggtccgggtacccggg

SEQ ID NO: 281056 - DNA, 642 bp, Homo sapiens
  misc_feature: GYAE6OF01BXEVJ.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtgttaataactatgtctcctggtaccaacaacaccaggcaaacgcccccaaactcatcatttatgacgtcactcatcggccctctaggggtttctactcgcttctctggctcagtttgcacacgcctcctgactatttcgtggtctccaggtctggaggacgagtctagtaattttatgtctcctcatacgtacaggctagcacgacctaaccccgtttatcgttaccgttcggtaaacgtacgggaacctaacggtcctacccgttaccgtaccgtccaccgaccccgaacggacccctaaaccccgtacctcggttacctacccgtttccgttcccggtttccccccgaccccctttcccgttacccgtaaccggtttaccggaacccttacccggtaaccgttacgggaaccgggtcccggggtaccccggg

SEQ ID NO: 281057 - DNA, 618 bp, Homo sapiens
  misc_feature: GYAE6OF01A3RIU.38.38.D05.1.454.CMB.1.raw
  modified_base (280)..(280): a, c, t, g, unknown or other
  misc_feature (280)..(280): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttaataaatatgtctcttggtaccaacatcaccaacatcacccaggacaaacgtccccaaactcataattangaggtacactaacggcctcaggtagtttcaatcgcttctctgctccaagtctggaccaacaccggcctccctgaccatccgtcgtcggcctacccaaccgtggaggacgaggctcaactattatgcagctcattatacaagcagtcgtctacgttagggtcgttcgggcgggtacgggacccgtacgtcgtaccgttcgttacggtcctacggaccccgaaagggtcccgtcccggtaccccccgtcgggttacccaacccgtttcccgttccccggtttcccccccggcccccttaccccgttacgtaacccggttcgaccgttcccgggtaaccgg

SEQ ID NO: 281058 - DNA, 541 bp, Homo sapiens
  misc_feature: GYAE6OF01A8UEU.38.38.D05.1.454.CMB.1.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (479)..(479): a, c, t, g, unknown or other
  misc_feature (479)..(479): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacacncccaggcaaacgccccaaatcatcatttangacgtcactcatcggccctcgagggtttctactcgcttctctggctcctagtttgacaacacggcctccctgacctatttcgtgggcctccgaggctgaggacgaggctagtaattttatgctcctcatatacagcagcagcctacccttatcgtcttcggaactcgggaccaggtccaccgtcctacgtccacgacccgaacgcccaacccnctcgtccaccttccgtcgttaccccacccttcctactacgtgactccgactgcggcggtacg

SEQ ID NO: 281059 - DNA, 674 bp, Homo sapiens
  misc_feature: GYAE6OF01C15CI.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgtataactatgtctcctggtaccaacaacacccaggcaaacgccccaaactcatcatttatgacgtcactcactccggccctcgtacggggtttcctacgtcgtctttcctcgtcggtcctccgtaagttttcggacaaccgaccggccctaccctcgacccttatttccgtacggggcctaccgaggtctggaacggacggtaggtaccttaggttaaattttacttcgtaccttccctactaagttaactaacgaggtcaagtaccgacgtaccctaaccccgtttagttacgtcgtttaccggaacgtacgggaacctaacgggtcctaacccggttcctacgtccgaaccgacccgaaccggcccctaaaccccgtactaccgtacctaccttccgttacccgttacccccaccccttcccaccgtacgtcgaccgttaccgactcgggaccggtcgggtaccg

SEQ ID NO: 281060 - DNA, 592 bp, Homo sapiens
  misc_feature: GYAE6OF01AZC42.38.38.D05.1.454.CMB.1.raw
  modified_base (274)..(274): a, c, t, g, unknown or other
  misc_feature (274)..(274): n is a, c, g, or t
  modified_base (373)..(373): a, c, t, g, unknown or other
  misc_feature (373)..(373): n is a, c, g, or t
tcagtcgatcacgtcacgaccggtgctcgatttagtatctgataggttagggtttaggggctttgcctgggctctgctgctacctcaccctcctcactcagggcacagggtcctgggcccagtctgccctgactcagcctgcctccgtgtctgggtctcctggacagtcgatcaccatctcctgcactggaagcagtagtgacattggtgttaataactatgtctcctggtaccaacaacacccaggccaaacgccccaaactcaatcatttangacgtcactcatccggccctcgaggggtttcactcgcttctctgctccaagttgcaacgcgcctcctgacctattcgtggcctcgaggctggacgacgnggtctagtaattttagtcgtctcgtacatactacgagcacggacacgcctaaccctttgtcgttacgttacggaacgtcgggaaccgtagtccgaccgttccgtaccgtcgaaccgacccgtaacgaccctaacccgtagtccgtacctaccgttcgttccgttccccgcccgttcctaccgtacgttcgaccttacgacgttcgcggtccggtaccgg

SEQ ID NO: 281061 - DNA, 911 bp, Homo sapiens
  misc_feature: GYAE6OF01ECGW2.38.38.D05.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtagttaataaatntgtcttcttaggtaaccaacactcaaccaaacactaccacccgaggaccaaaacgtacccccaaaactctaattaatttatagtaacggtacaaccgtaaacccggtccctacgtaaggtacgtttactaacttcgtaccttctacgtcggtcctaccgtaaacgttcgtacggacctaaaccgtacccgggtacccttaccccgtacggaacccctaacgttcccgtttaccggttaccggggtacccttaccccgtaaaacccgggtttacggggaaaccgggtaacccggggtaaccgggttacccttaacccgttaaaccgttttaacgtttttaaaccgtttccgggaacccgtaacggttaccctttaaccgtaaactttaacgtaaaccgtaaacgggtccgtaaacgggttcccgttaccgtttaacgggttttcgggggtttaccggggttacccgggggtaaccggggtaacccggggtaacccgttacccgggttaccggtacccgggtttacggtttacggacccgtaccggaccccgtaacggggtcccttacccggaccccccggtttacggtacccgttaccttccccggtttccccggttacccccctttaccccccgtacccgttaccggttacccggttaccggtaacccgttcccgggtaccggttaccgggg

SEQ ID NO: 281062 - DNA, 537 bp, Homo sapiens
  misc_feature: GYAE6OF01BF8HE.38.38.D05.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (488)..(488): a, c, t, g, unknown or other
  misc_feature (488)..(488): n is a, c, g, or t
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttatgacgtcactcatcggccctcgagggtttctactcgcttctctggctccaagtttgacacncgcctcctgacctatttcngggctacaggctggacggacgaggctagtaatttttatgtccttcctcatatacaggcagcacgcctacccttatcgtacgtacggaacgtcgggacctaaggtccaccgtcctacgtcacgcccaacggcccaacccntcgcacctcgtcttccccacctccncacgtgactcgacncggngcggtc

SEQ ID NO: 281063 - DNA, 869 bp, Homo sapiens
  misc_feature: GYAE6OF01EJ69M.38.38.D05.1.454.CMB.1.raw
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctcgtgtctgggtctcctggacagtcgatcaccatctcctgctacgtggaagcagtagtgacagttggtgttataactagtcgtctcctaggtaaccaacaacaccaggcaaacgcccccaaatcatctattatcgacgtcactcactcgccctcgtaggggtttcctacgtccgtcttctcgtggtcctaccgtaaggtttcggaccaaaccgaaccccgggtcccttaccccgtacggtaaaccctaacgttttccggtacgggggtcccttacccggaacggtaccgttcgggaaacggggtaccgggtaggtaccgtttacggttaaaattttttacggtacgttcccgttaccctaccgttaattacgttaaaccgacgggtacccaagtaccgtaccggaccctttaaaccccccgtttagttaccggtttacccggtttaacccggggaaaaccgtttacgggggtaaaacccccgtaacgggtttaaccccgtaacccccggtttaacccggtaacccggtttacccgaaaccgggttaaccccccgaaaccgggttaaccccccccaaacccccgttacggtacccggttacccctaaacggttttcccccggttaaccccgggttttcccccccaccccggtttacccttacccggtaaacccgttacggttaaaccgtacccgggttaaccgttacgggtccgggtaccgggggtaccgg

SEQ ID NO: 281064 - DNA, 586 bp, Homo sapiens
  misc_feature: GYAE6OF01CNHUB.38.38.D05.1.454.CMB.1.raw
  modified_base (503)..(503): a, c, t, g, unknown or other
  misc_feature (503)..(503): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtgttataactatgtctcctagaccaaacacaccgaggacaacgcccaaactcatcatttatgacgtcactcactcggccctctaggggtttctactcgcttctctggctctagtttgcaacgacggccctcctgacctattcgtggctccgagctggaggacgagctagtaattttagtgtctctcatatacaggctagacacgtacctacccgttatcgttcgttacggaacgttcgggaacctaacggtccaccggttacctaccgtacgaccgacccgaacggacccaaccccnttaccgacctaccgtccgttccgttccccgtccctcctaccgtacgtaccgtacgtaccgtacgtacgggcgccgggtaccgg

SEQ ID NO: 281065 - DNA, 598 bp, Homo sapiens
  misc_feature: GYAE6OF01AQ6TZ.38.38.D05.1.454.CMB.1.raw
  modified_base (452)..(452): a, c, t, g, unknown or other
  misc_feature (452)..(452): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctccgtggtaccaacaacacccaggccaaagccccaaatcatcatttatgacgtcactcatccggccctcgtacggggttttcctaccttccgcctttctcgtcggcctaccgtaagtttggaccaaccgtaccggccctccctgacctagtttctcgggctccgaggctgacggacgagtcttagtaatttttagtcgtccttccgtactatacgtacgaggcagcgtacncctacccttatcgtcgttacggaacgtcggaccaacgtccaccgtcctacgtcacgaccaacgcccaaccctctacgtcctacctccgttccggtccccgccctcctaccgtacgtcgtacgtcgtacgtcgacggtcgggtaccg

SEQ ID NO: 281066 - DNA, 569 bp, Homo sapiens
  misc_feature: GYAE6OF01CNXPF.38.38.D05.1.454.CMB.1.raw
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactntgtctctggtaccaacaacacccgaggcaaacgccccaaactcatcatttangacgtcactcatccggccctcgtagggggtttcctacgtcgtcgttctctggctccgtaagtttggaccaacacggccctccctgacctagtttctgggtctccaggctgaggcgaggctagtaatttattgctctcatatacgagcagcacgctacccttatcgtcgttacgaacgtggaaccgaggtccaaccgtcctacgtcacgacccgaacggacccaacccgtctcgtcctacgtccttccggttccccgcccttcctccgtacgttcgtactaccgacgtcggcggcggtccgg

SEQ ID NO: 281067 - DNA, 617 bp, Homo sapiens
  misc_feature: GYAE6OF01CLLUV.38.38.D05.1.454.CMB.1.raw
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (606)..(606): a, c, t, g, unknown or other
  misc_feature (606)..(606): n is a, c, g, or t
tcagtcgatcacgtcacgaccggtgctcgatttagtatctgatagttgggtttgggggctttgcctggactctgctgctcctcaccctcctcactcagggcacagggtcctgggcccagtctgccctgactcagcctgcctccgtgtctgggtctcctggacagtcgatcaccatctcctgcactggaagcagtagtgacagttggtgttaataactatgtctcctaggtaaccaacaaccacccaggaccaaaacgccccaaactcatcatttatgacgtcactcacgtccggtacctcgtaacgggttttccacttccgcttctctcggtcctccgtaagtttcggacaaccgtaccggccctcctcgtaacctagtttccgtcgggtacctccgaaggtccgtaggacggacgaggtctagtaattttagtcgcttcctanataactacgngtacagccagcctacccttagtcgtacttacggaactacggacctaacggtccacccgttcgtaccgtcaccggaccaacgaccccaacctcgtctaccacgtcccgtacgttcccccaccttcctaccgtacgtacgtacgtcgacgtcgnggtaccggtcg

SEQ ID NO: 281068 - DNA, 603 bp, Homo sapiens
  misc_feature: GYAE6OF01CSH6I.38.38.D05.1.454.CMB.1.raw
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtagttataactatgtctcctaggtaccaacaaccaccaggacaaacgccccaaactcatcatttatgacgtcactcatcggccctcaggggtttctactcgcttctctggctctagttgacacacgccctcacnctatcgcgctcgngtcagacggagagntagttattntcgtctctataatatacgacgcgacgacgacgtaccctaccttagtcgtacgttacgtaacggtacggaacgtacgtacccgaccgttacgtaccgtacgaccgacccgtaaccgacccctaaccctcgttaccgtaccgtaccttccgttaccccgttcccccgtccccgttccctaccgtaccgtacgtaccgtaccggtacgtacggccgggtccgggtaccggg

SEQ ID NO: 281069 - DNA, 878 bp, Homo sapiens
  misc_feature: GYAE6OF01B37OB.38.38.D05.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctggctcctcaccctcctcactcaggcacagggtcctgggccctagtctgccctgactcagcctgcctccgtgtcgtgggtctcctggacagtcgatcaccatctcctgcactggaagcaggtagtgacattggtgttataactntgtctcctggtaaccaacaacacccgaggaccaaacgcccccaaactcaatactaatttatgaccgtcactacactccggaccctcgtaggggtttcctacttcgtcttctcgtcggtccttaccgtaaggttttcgggacctaaaccgtacccgggtccccgttaccccgtacgggtaaccccttacgttttacccgttgggggtacccttaccggaacgggtccgttacgggaacggggtaccggtaacggggtaccgttttaagggttaaaacttttttttacgttacggttcccctttaccccgttaaccgtaaactttaaccgttaaccgaaccggggtaaccgtaaccgggtaccgtaaccggtaccccgttaaaccccccgttttaagttaccgggttttacccggtttaaccggggtaaacccggtttacggggtaaaccccgttaaaacgggttccccgtaaaccccggtttcccgttaaccggttaccgaaaccggttacccccgaaacggtaccccctaaacccccgtacttccggttacccctaccgtttacccgttcccggttaccccccgtaccccgttacccgttaccgtaacccggttacgtaaccgttaccgaaccgtcgggtaacggtccggggtacccgg

SEQ ID NO: 281070 - DNA, 562 bp, Homo sapiens
  misc_feature: GYAE6OF01ACCU7.38.38.D05.1.454.CMB.1.raw
  modified_base (430)..(430): a, c, t, g, unknown or other
  misc_feature (430)..(430): n is a, c, g, or t
  modified_base (492)..(492): a, c, t, g, unknown or other
  misc_feature (492)..(492): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtgttataactatgtctcctggtaccaacaacaccaggacaaacgcccccaaactcatcatttatgacgtcactcatccggccctcgaggggtttctactcgcttctctggctcaagtttgcacacggcctccctgacctatttcgtgggcctccgaggctggacggacgaggctgtaatttttatcgcttcctctaatatacgaggcagcacgcctacccttancgttcttacggactgggacctaaggtccaccgtcctagtccacgacccaacggcccaacccnctcgtcctactccgtccgtcccctaccctccctacgtacgtcgtacgtccgacgcggacggccggtacgg

SEQ ID NO: 281071 - DNA, 585 bp, Homo sapiens
  misc_feature: GYAE6OF01DS9H9.38.38.D05.1.454.CMB.1.raw
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
  modified_base (430)..(430): a, c, t, g, unknown or other
  misc_feature (430)..(430): n is a, c, g, or t
  modified_base (539)..(539): a, c, t, g, unknown or other
  misc_feature (539)..(539): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtgttataactatgtctcctggtaccaacacacccaggcaaaacgccccaaactcatcatttatgacgtcactcactcggcctcgtaggggtttctactcgcttctctggctcctaagtttcggacaacacggcctccncgacctatttcgtgggcctccaggctggagacgaggctagtaattttatcgctcctntatatacgaggcagcatcctaaccctttntcgttcgtacggaacgtcgggaacctaaggtcctaaccgtcgtaaccgtcaacggtacccaacggaccctaaccccgtacgtcgtcctaccgttccgtccgttaccccncccttccctcgtaccgttcgacttacgactcggacgtccgggtacg

SEQ ID NO: 281072 - DNA, 603 bp, Homo sapiens
  misc_feature: GYAE6OF01DEN7O.38.38.D05.1.454.CMB.1.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (349)..(349): a, c, t, g, unknown or other
  misc_feature (349)..(349): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatccaccatcctcctgcactggaagcagtagtganagtttggtagttaataaactntgtctcctaggaaccaaacaacaccaggacctaaaacgccccaaactcatctaattatgacgtcactcatcgcctcgtagggtttctacgtctcttctcgtgtctacctaagtttcggactaaaccncggtccctccctacgacctactttcgtcggcctcgagctggacgacgaggtctagtaattttatgtactctactatatacagcagcagacccaccttatcgttcgttacgaacgtacggacctaaggtccaccgttacgtaccgtacgaccgacccgaacgacccaaccctacgttccgacctaacttcccgtacggttcccccgtccctcccgtacgtaccgtacgtacgttcgaactcgggagccgggtacg

SEQ ID NO: 281073 - DNA, 574 bp, Homo sapiens
  misc_feature: GYAE6OF01BZ807.38.38.D05.1.454.CMB.1.raw
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtggttaataactatcgtctcctggtaaccaacaacacccaggcaaacgccccaaactcatcatttangacgtcactcatcggccctcgacgggtttctactcgcttctctggctcagttgcaacacgcctccngacctattcgngggcctcgaggtctggacggacgaggcttagtaattttatcgtcttcctanacttatacgtaggctagcgacncctacccttatcgtcgttacggaactcgggacctaaggtccaccgttccgtacgtcaccgacccaaggccccaaacccgtctcgttccaaccgttccgtcgttaccccaccctccctacgacgttcgtaactccgattcggaggccggtcg

SEQ ID NO: 281074 - DNA, 526 bp, Homo sapiens
  misc_feature: GYAE6OF01EZ35R.38.38.D05.1.454.CMB.1.raw
  modified_base (351)..(351): a, c, t, g, unknown or other
  misc_feature (351)..(351): n is a, c, g, or t
  modified_base (476)..(476): a, c, t, g, unknown or other
  misc_feature (476)..(476): n is a, c, g, or t
  modified_base (519)..(519): a, c, t, g, unknown or other
  misc_feature (519)..(519): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaaagcccccaaactcatcatttatgacgtcactcatcggccctcaggggtttctactcgcttctctggctccaagtttggcaacacggcctccctgaccatttcngggctccaggctgaggacgaggctgtaattttatgtctcctcatatacaggcagcagccaccccttatcgtcttcggactgggaccaaggtccaccgtcctacgtcacgcccaaggcccaacccntcgtcactctcgttcccacctcctccacgtcgactcgactggngcggtcg

SEQ ID NO: 281075 - DNA, 873 bp, Homo sapiens
  misc_feature: GYAE6OF01BZYDU.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcaccatctcctgcactggaagcagtagtgactagtttgggtagttaataactatcgtctccgtaggtaacccaaacaaccacccgaggccaaaacgccccaaactcatcatttatgacgtcactcactccggcccctacgtaggggtttctacgtccgtcttctctcggctccgtaagtttcggaccaaaccgaccgggtcccttccccgtacgtaaccctaagttttcgtacggggtccctaccgacggtcgtacggaacgggtaccggtacgggtaccttaagggttaaaactttttttacgtttaccggttacccttaccccgttacgtaaactttaacgttaaacccggtaacgggtacccgaaacggtacccgtaaaccggtaccccgttaaacccccccgtttttaagttacccggttttacccggtttaacccggggtaaaaccgtttaccggggggtaaaaccccgttaaaacggggttacccccgtaacccccggtttaccccgttaacccggtttacccgaaaccgggtaaccccccgtaaaccggggtaccccctaaaacccccgtacgttacccggttaccctaacccgtttccgtttacccggttaccccccgcccccgttacccgttacccgtaaccggttacgtaacgttacccgtaaccggttcgggaaccgggtccggggttacccgg

SEQ ID NO: 281076 - DNA, 536 bp, Homo sapiens
  misc_feature: GYAE6OF01E4SBO.38.38.D05.1.454.CMB.1.raw
  modified_base (351)..(351): a, c, t, g, unknown or other
  misc_feature (351)..(351): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaaagcccccaaaactcatcatttatgacgtcactcatcggccctcaggggtttcactcgcttctctggctccaagtttggcaacacggcctccctgaccatttcngggctccaggctgaggacgagctgtaattttatgctcctcatatacaggcagcacgccaccccttatcgtcttcggaactgggaccaaggtccaccgtcctacgtccacgcccaacggcccaaccccactctccacctcgtccgttccccgccctccctcacgtcgactcgactggcgcgggtcg

SEQ ID NO: 281077 - DNA, 466 bp, Homo sapiens
  misc_feature: GYAE6OF01COC66.38.38.D05.1.454.CMB.1.raw
  modified_base (308)..(308): a, c, t, g, unknown or other
  misc_feature (308)..(308): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (452)..(466): a, c, t, g, unknown or other
  misc_feature (452)..(466): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaaagcccccaaaactcatcatttatgacgtcactcatcggccctcaggggtttctactcgcttctctggctccaagtttgcaacacggcctcctgaccatttctgggctccgaggctgagacgaggctgtaattttatgctcctnatatacaggcagcagcactccttatgtctcggactgggaccagtcaccgtctacgtcacgcccaaggcccaacccntcgtcaccttctcgttccccaccctctacacgtnactcgactggacgcggtcnggcaaggcncatagnnnnnnnnnnnnnnn

SEQ ID NO: 281078 - DNA, 488 bp, Homo sapiens
  misc_feature: GYAE6OF01AJS7R.38.38.D05.1.454.CMB.1.raw
  modified_base (316)..(316): a, c, t, g, unknown or other
  misc_feature (316)..(316): n is a, c, g, or t
  modified_base (466)..(488): a, c, t, g, unknown or other
  misc_feature (466)..(488): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctggaggacgaggctgtaattttatgctcctcatatacnggcagcagccaccccttatcgtcttcggaacgtgggaccaaggtccaccgtcctacgtcacgcccaacggcccaacccctactcgtccactccgtcgttccccgccctcctcacgtgactcgactgcgcgggctggcaacggcgcatcgnnnnnnnnnnnnnnnnnnnnnnn

SEQ ID NO: 281079 - DNA, 602 bp, Homo sapiens
  misc_feature: GYAE6OF01BE8W5.38.38.D05.1.454.CMB.1.raw
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
  modified_base (542)..(542): a, c, t, g, unknown or other
  misc_feature (542)..(542): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactgggaagcagtagtgacattggtggttaataactatgtctcctggtaccaacaacaccagcaaacgcccccaaatcatcatttatgacgtcactcatccggccctcgtaggggtttctactcgtcttctctggctcctaagtttgacaacacgcctccctgacctattcgnggctcaggctgaggacgaggctagtaattttatcgctcctnatatacaggcagcacgcctaccccttagtcgttcgttacggaacgtcgggaacctaacgggtcctaccgttcccgtacgtaccgacgaccccgaacggaccccaaacccctacgtcgttaccaccgttcccgtccggttacccccnccccttccctaccgtaccgtaccgtacgttaccggtaccgtcggacgggtcgggtaccgg

SEQ ID NO: 281080 - DNA, 607 bp, Homo sapiens
  misc_feature: GYAE6OF01CW9EE.38.38.D05.1.454.CMB.1.raw
  modified_base (270)..(270): a, c, t, g, unknown or other
  misc_feature (270)..(270): n is a, c, g, or t
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtaggttataactatgtctcctgtaccaacacacccaggcaaacgcccaaaactcaatcatttangacgtcactcatcggcccctctagggggtttcctactccgtcttctcgtcggctcctaagtttggaccaacgaccggcctcccgtacgacctaatttcgtgggtcctcgaaggctggaggcgaaggctagtaattttatgctctntatatacgagcagcacgcctaacccttntcgtcgttacggaacgtgggaaccaacggtcacccgtacgttaccgtnaccgtacccgaaccggccctaaaccgacgtacgtacctaccgttccgtccggttccccccgtccccttacccttccgtaacgttcgtactaccgagttcggaaggccgggtaccgg

SEQ ID NO: 281081 - DNA, 618 bp, Homo sapiens
  misc_feature: GYAE6OF01EQZIB.38.38.D05.1.454.CMB.1.raw
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacacccaggcaaacgccccaaatcatcatttatgacgtcactcatccggccctcgaggggtttctactcgcttctcgtgctccaagtttgcaacncggcctccngacctatttcgngggctccgaggctggacggacgaggtctagtaattttagtcgcttcctctatatacgagacacgcacgtcctacccttatcgttcttacgggaacgtcgggaccaaggtcctaaccgttcctacgtcgaccgtacccaacggaccccaacccgtctaccggtaccctaacccgttccgttacccggtttcccccgtaccccttcccgttcccgtaacccggttcggaaccttccggtaaccgttccgggaacgggtccggggtacccgg

SEQ ID NO: 281082 - DNA, 840 bp, Homo sapiens
  misc_feature: GYAE6OF01CC7PL.38.38.D05.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactagttggtaggttaataactatcgtctccgtaggtaaccaacaaccacccgaaggaccaaaaccgacccccaaaactccaatcctaatttatagacgtcactcactccggcctccccgtagggtttctacgtcgtcttcctcgtcggtcctaccgtaagtttcgggaccaaccgtaccggtcccttcccgtacgtacccttaagtttccggtcgggtccctacccggtacgggtccgtacggaacgggtacggtacgggtaccgtttaggtttaaacgtttttacgttcggtaccctttaccccgttactaacttacgttaaaccgacggtacctaacggtacctaaccggtaccccttaacccccgttttaagttccggtttacccggtttaaccgggtaaccggttaccggggaacccgttaaacgggtcccgttaaccccggttcccgttaaacccgggttcccaaaccggtacccccggtaaaccgggtacccccctaaacccccgtaccgtttaccggtaccccttaccgtttaccccgttacccgtttaccccccctaccccgtttccccgtacccgtaaccgttccggtaacctaccggtaaccgtttcgggaccgggttccggggtacccgg

SEQ ID NO: 281083 - DNA, 594 bp, Homo sapiens
  misc_feature: GYAE6OF01EC92D.38.38.D05.1.454.CMB.1.raw
  modified_base (190)..(190): a, c, t, g, unknown or other
  misc_feature (190)..(190): n is a, c, g, or t
  modified_base (381)..(381): a, c, t, g, unknown or other
  misc_feature (381)..(381): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactagtttggtagttaataactatcgtctcctaggtaaccaacaacacccgaggaccaaacgccccaaatcatctattatcgactcactcacgtccggcccttcgtacggggtttctactcgtccttctcgtcgcctactagttcgacaacgaccgcctacctgtacctattcgtcggctcgngctggagacgagtctagttaatttgtcgtcctactacattactacgagcagcacgtcctacccttgtcgttcgtacgacgtacggacctacgtcctaccgtactacgtacgacgacccgacgaccctaaccgcgtcgtacctacgtccgttccgttaccccacccttcctaccgtaccgtcgtacctacgtacggtacgcggtccggtaccgg

SEQ ID NO: 281084 - DNA, 550 bp, Homo sapiens
  misc_feature: GYAE6OF01EW5J7.38.38.D05.1.454.CMB.1.raw
  modified_base (353)..(353): a, c, t, g, unknown or other
  misc_feature (353)..(353): n is a, c, g, or t
  modified_base (399)..(399): a, c, t, g, unknown or other
  misc_feature (399)..(399): n is a, c, g, or t
  modified_base (490)..(490): a, c, t, g, unknown or other
  misc_feature (490)..(490): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttaataactatgtctcctggtaccaacaacacccaggccaaacgcccccaaatcatcatttatgacgtcactcatcggccctcaggggtttctactcgcttctctggctccaagtttggcaacacggcctccctgacctatttcngggctccgaggctgaggacgaggtctagtaattttatcgctcctanatatacaggcagcacgcctacccttatcgtcttacggaactcgggaccaaggtccaaccgtcctacgtcgacgcccaacggacccaacccngtcgtccacttccgtcgttccccgcccttccgtccacgtcactcgactcggagcgggtcg

SEQ ID NO: 281085 - DNA, 633 bp, Homo sapiens
  misc_feature: GYAE6OF01EML59.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgcccccaaactcaatcatttatgacgtcactcatccggcccttcgaggggtttctactcgtcttctctggcttctaagtttgacaacgaccggtcctcccgtgtacctatttctcgggtctccgaggctggaaggacgaggtctagtaactttttatcgccttcctctaattactacgaggcagacacgcctaacccctttatcgtacgttaccggtaactcgggaaccctaaggtccacccgttacctacgtccgacgtaccccgaaacggccccaaacccctcgtcgtaccaccgttccgttccggtttacccccgccccttccgtaccgtacccggttcgtaaccgttccggaaccgttgggaaccgggtcggggtacccgg

SEQ ID NO: 281086 - DNA, 616 bp, Homo sapiens
  misc_feature: GYAE6OF01CXL4X.38.38.D05.1.454.CMB.1.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttaataactatgtctcctggtaccaacacacccaggcaaacgccccaaactcatcatttangacgtcactcatcggccctctaggggtttcctactcgcttcnctggctccaagtttcggcaacacggcctcctcgacctatttctggggtccttccgaggctgaggacgaggctagtaattttatgctctacatatacaggcagcacgcctaccctttatcgtcttacggaacgtcgggactaacgggtccaaccgtcccgtaacgtccgacgccccgaacggtcccaaaccccgtactccgtacctaaccgttcccgttaccgtttcccccgaacccctttcccgttacccgtaaccggttaccgtaacgttacccgtaccggttacggcgggcccggggtaccgg

SEQ ID NO: 281087 - DNA, 693 bp, Homo sapiens
  misc_feature: GYAE6OF01AEM1A.38.38.D05.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattggtggttaataactntgtctcctgtaccaacacaccaggcaaacgccccaaactcatcattatgacgtcactcatccggccctcgtacggggtttctacgtcgcttctcgtcggcctacgtaagtttgactaacgaccggtccctacccgtcgacccttacgtttcgtcgggtcctccgaggcgtggaagggacggaggtcgttagttaatttttacgttgtcccttcctactaattaacgtaaccgaggtacaacggtaccaacggtaccctaccccgtttatcggttacccgttaaccgggaaccgttacgggaacccgtaacggttacccgtaaccccgttcccgttaaccggtccgaacccgtaccccggaaccgaccccaaccccgtacttaccggtaccctaccgttcccgttacccgttaccccctaaccccttcccgtaccgtaccgttcgacgtaccgtaggtcggacggtcgggtaccg

SEQ ID NO: 281088 - DNA, 559 bp, Homo sapiens
  misc_feature: GYAE6OF01B9PKV.38.38.D05.1.454.CMB.1.raw
  modified_base (238)..(238): a, c, t, g, unknown or other
  misc_feature (238)..(238): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctcctggtaccaacaacnccaggcaaaacgcccccaaactcatcatttatagacgttcactcatcggccctgaggggtttctactcgcttctctggctcagtttggcaacacggcctcctnacctatttcncgggctccgaggctgagacgagctagtaattttatcgctcctctatactacaggcagcacgcacccttatcgtctcggaactggacaggtctaccgtctacgtcacgtacccaacggccccaaaccctcgtacgtcctaaccgtccttaccggttccccgccccttcctcctacggttcgacttcggacttcggaggccgggtaccgg

SEQ ID NO: 281089 - DNA, 706 bp, Homo sapiens
  misc_feature: GYAE6OF01EM5DP.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattggtgttataactatgtctcctggtaccaacaacaccaggaccaaacgcccccaaactcatcatttatgacgtcactcatccggccctcgtacggggtttctactcgtcttctcctggcctactaagtttggacaacgaccggccctccctcgaccctagtttcgtcgggtcctccgaggtcctaggacggacggaggtccttaggtaaatttttagttcggtccctttacccgtactaacttacgttacgacggtacaacggaccgacgtacccctaccccttttattccgttacccgtttcgggaaacgttccggggaaccctaacgggtcccaacccggttccctaccggtaccgaccgaccccgaaccggacccccaaaccccgtacgtcctacccgtaaccttcccgttaccccgttacccctacccccgttccctacccgtaaccggttacgtaccgttaccggtaacccttcgggaccgggtcccggggtaaccgg

SEQ ID NO: 281090 - DNA, 666 bp, Homo sapiens
  misc_feature: GYAE6OF01CKGPY.38.38.D05.1.454.CMB.1.raw
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatcctccngcactggaanctagtagtgactagttggtagttaataactntgtactcgtacgaaccaanacaccgagacaacgcccaatcatctattangactcactcacgtccgcctagtacggttctacgtcgtcttctctcgtctacgtagttcggaccacgtaccgtccctcgtacgtaccttagtttcgcggtacctcgaggtcgtaggacggtaacgtacggttacttaagttaacttttcgtcgtaccttacgtactattaacgacgacggacgtacgtacctacgtaccctaccttagttccgttaccgtacgggtaacgtccgggtaaaccgtacggtcccgtaccgtaccgttaacgaccgaccgtacccgaaccgtaaccccacccgtatcccgtacgtccttcccgttcccgtaccccctaccgtccttaacgacgttacgtacccgtacggaaacggtcgggtaccggtccggggtaccgg

SEQ ID NO: 281091 - DNA, 730 bp, Homo sapiens
  misc_feature: GYAE6OF01ARJ46.38.38.D05.1.454.CMB.1.raw
  modified_base (200)..(200): a, c, t, g, unknown or other
  misc_feature (200)..(200): n is a, c, g, or t
tcagtcgatcacgtcacgaccggtgctcgatttagtatctgatagttgggtttgggggctttggcctggggctctgctgctcctcaccctcctcactcagggcacagggtcctggggcccagtctgccctgactcagcctgcctcgtgtctggggtctcgtggacagtcgactcacctatcctcctgccacgtgggaacncgtagtagtgacgacgttggtagttaactactatcgtctccgtaggaaccaactaacgacccgaggtacaaaaccgtcccctaaagtctatactagtttacgtacgaaccgtctacgtacacgtaccggtcccctacgtacgggtttctacgtcgtactctcgtacggtacctaccgtaacgtttcgaccgtaacgtaccggtccttccctacggtacccttagtttcccggtcgggtcctaccgtacggtacgtaggacgggtacgtacggtacgttagttaaacttttcgttcgtaccgttcctagtacgttaacgtacggacgtacgtacgtacgtaccgttacccgttaccgtttagtcgttaccgttacgggaacggttcggtaaccgtacggttaccaccgttaccggacttaccgacgacccgtaacggtacccaaccgtcgtacgtacctaccgtcgttaccgtccccaacgtccctacggacctacgacgtaccggtaccgacggtccggtaccggtccgg

SEQ ID NO: 281092 - DNA, 728 bp, Homo sapiens
  misc_feature: GYAE6OF01B88C9.38.38.D05.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagtcgatcacgtcacgaccggtgctcgatttagtatctgatagttgggtttgggggctttgcctgggctctgctgctcctccaccctcctcactcagggcacagggtcctgggcccagtctgccctgactcagcctgcctccgtgtcgtgggtctcctggacagtcgatcaccatctcctgcacgtggaancagtagtagactattggttagttaataaactntcgtcttccgtggtaaccaacaaccacccgaaggaccaaaccgacccccaaaactccaatctaatttatgaccgtcacttcgaactccggtccttcgtagggtttcctcctcgtcttctacgtcggtccttactaaggtttcggacctaaccgaccgtccctccctacgtaccctacgttcggttcgggaccttcccgaggtccgtaggacgggacgtacggtacttaggtaattttacgtacgtcctttacttatacgtacgacggacagacacggtcctaccccttagtacgttacgttacgaaccggtcgggaacctaacgggtcctacccgttaccttaaccggcccgtaaccggaacccctaacgggaccccctaaacccgtaccgttccgtaccctaccgttcccttcccgttaccccccgtacccttaccccgtaccgtaaccgttcgaaccctttaccggaacgttaccggaccggggtcggtccgtaaccgggg

SEQ ID NO: 281093 - DNA, 524 bp, Homo sapiens
  misc_feature: GYAE6OF01DF7ZT.38.38.D05.1.454.CMB.1.raw
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
  modified_base (518)..(518): a, c, t, g, unknown or other
  misc_feature (518)..(518): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaaactcatcatttatgacgtcactcatcggccctcaggggtttctactcgcttctctggctccaagtttggcaacaccggcctccctgacctatttctgggctccaggctgaggacgaggctagtaattttatgctcctcatatacaggcagcagcctacccttatcgtcttacggaactgggaccaaggtccaccgtcctacgtcacgcccaaggcccaacccactcgcactctcgtcccnccctccncacgtcgatcgatgngcggcg

SEQ ID NO: 281094 - DNA, 683 bp, Homo sapiens
  misc_feature: GYAE6OF01CIFDR.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattggtaggttaataacttatgtcctcctaggtaacccaaacaaccacccaggcaaaacgcccccaaactcatcatttatgacgtcactcactccggccctcgtacggggttttctactccgtcttctcgtcggtctaccgtaggtttcgacaaccaccggccctcccgtacacctacgtttcgtcgggtctccgaggcgtaggacgggacgagtcgttagttaattttattcgtaccttcctactataagttacgaggacacgacacgccctaaccccgtttatcgttacgttacgggaaccgttcgggaaccctacgggtaccctacccggtaccgtaaccgtccgaccggacccaaccggacccaaccccgtacgttaccgttaccctacccgttccgttcccggttacccccgtccccttcccgttcccgtacggttaccgtacgttacccgacggttcgggtaccggcgggtaccgg

SEQ ID NO: 281095 - DNA, 685 bp, Homo sapiens
  misc_feature: GYAE6OF01BXX2R.38.38.D05.1.454.CMB.1.raw
  modified_base (269)..(269): a, c, t, g, unknown or other
  misc_feature (269)..(269): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggaccaaagcccccaaatcatcatttangacgtcaactcacgtcggccctctacgggtttctactccgtcttctcgtggctcaagtctggaccaaccgaccgccctcctcgaaccactctccgtggtaccctaccgtaacgtggacggacgaggtccttacgacttaatttacgttcgctagtcctacgtaataagttaacaacgtacaggtccgttacctaaccggtttggggttaccggttccgggaccgggtacggggaaccccgtacccgttacgggtaccccgtttcgtttaaccgggtaccaacgggtaccccaacgggtccctaccgtccccccggttacggtccctaccgtttcccgttacccgttcccccggtcccccttccgtaccgttaccggttacgtaccgttaccggtaccgttggaccggtacccgggg

SEQ ID NO: 281096 - DNA, 954 bp, Homo sapiens
  misc_feature: GYAE6OF01E3SA1.38.38.D05.1.454.CMB.1.raw
tcagtcgatcacgtcacgaccggtgctcgatttagtatctgatagttgggtttggggcgtttgccgtgggcctcctggtcctgcttcctcacccttccgtcactcaggcacagggtcctgggcccagtctgccctgactcgagtccgtgcctccgtgttcgttcggttctccgtggtacttaggtcgtactcgaccagtcgtcctgcgactgggaagcgtaggtaggtcgacgtagtttcggtaggtttaacgttaacggttacttggtaccgttcccttaccgggttaaccctaaacgtaacccgaaccccgaaggggtaccaaaaccggtacccccccgtaaaacttaccctaacgtttaccttaaagtttttaacttacggtaaccggtttacctaaccgttccgtaaccgttcccgggtaccccccgtttaccggttaaccggggggtttttacccttaaccgttccggtaccggtttaccggttaccgttacgggtccctttaaccgttaacggttttccggacccgtaaaccgtaccggtacccttacccgttacgtaaccgttaacgttttacgtacggggtacctaccgtaacggtcttaggaaccggtaaccggtacggtcggttaagttaacgttttttacgtcgtaccgttccttacctaacgttaacgtacggtaacggtaccgtaacgtaccaacggacccttacccgttagttcgtttaccgttaccggtaacggttacgggacccgtaaggttcccgtacccgttaccgttacgtacccgtaccggaacccgtaacggacccctaaccccgtacgtttacgtacccttaacccgttccgtttaccggtttacccccgaccccgttaccgttaacccgacggttaacccggtaacgttaccggtaccgggttaccggtaccggggcccgggtaacccggg

SEQ ID NO: 281097 - DNA, 588 bp, Homo sapiens
  misc_feature: GYAE6OF01DXEHF.38.38.D05.1.454.CMB.1.raw
  modified_base (294)..(294): a, c, t, g, unknown or other
  misc_feature (294)..(294): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (455)..(455): a, c, t, g, unknown or other
  misc_feature (455)..(455): n is a, c, g, or t
  modified_base (538)..(538): a, c, t, g, unknown or other
  misc_feature (538)..(538): n is a, c, g, or t
  modified_base (567)..(567): a, c, t, g, unknown or other
  misc_feature (567)..(567): n is a, c, g, or t
  modified_base (580)..(580): a, c, t, g, unknown or other
  misc_feature (580)..(580): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatccaccatctcctgcacgtggaagcaaggtagtgacagtttggtaggttaataactattcgtcctaccgtggtaaccaacaaccacccgaggaccaaaaccgcccccaaaactcatacctatttancgacgtcactcagtccggcccttcgtaggggtttcctacgtccgtcttctcgtcggtctctagtttcgacaacgaccgcctcctgacctntttcgnggctcgaggctggacgacgagcttagtaattttagtcgtccttcctactataacttacgacggtnacgacacgcctaacccttgtacgttcgttaccggacgtagggacctaacggtctaccgtcctacgcacgccaaccgccacccntcgactactcgtccgtccctcctccacgntcgactcgatcgnggcggacg

SEQ ID NO: 281098 - DNA, 536 bp, Homo sapiens
  misc_feature: GYAE6OF01ENH1Y.38.38.D05.1.454.CMB.1.raw
  modified_base (267)..(267): a, c, t, g, unknown or other
  misc_feature (267)..(267): n is a, c, g, or t
  modified_base (353)..(353): a, c, t, g, unknown or other
  misc_feature (353)..(353): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacacaccaggacaaacgccccaaatcatctatttangacgtcactcactccggcccttcgaggggtttctactcgtcttctcgtggcttctagtttgacaacacgcctcctgactatttcgnggctccgaggctggacggacgaggtctagtaattttagtgtcttcctcatatacgagcagcacgtcctacccttatcgttctacggaacgtcggaccaaggtccaccgtcctacgtcacgacccaacgcccaaccntcncacctcgtcctcccncctcncacgtcactcgancggngcggtcg

SEQ ID NO: 281099 - DNA, 588 bp, Homo sapiens
  misc_feature: GYAE6OF01ES7P5.38.38.D05.1.454.CMB.1.raw
  modified_base (267)..(267): a, c, t, g, unknown or other
  misc_feature (267)..(267): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctgggtctcctggacagtcgatcaccatctcctgcactggaagcagtagtgacattggtgttataactatgtctcctgtaccaacaacaccaggaccaaacgcccccaaatcatcatttangacgtcactcatcggccctcgagggtttcactcgcttctctgctcaagttgcacacgcctcctgacatttcgnggctcagctgaggacgngctagtaattttntgctcctnatatacagcagcacgaccctaccctttatcgtaccgttacggaacgtacgggtaccaacggttcctacccgtacctaccgtacaccggaccccaaagggacccccaaaccccgtcgttcgttaccctacccgttacctcccggttaccccctccccctccgttacccgacggttcgtaccgtacgtacccgtggtaccggcggggtaccg

SEQ ID NO: 281100 - DNA, 294 bp, Homo sapiens
  misc_feature: GYAE6OF01AUWQS.38.38.D05.1.454.CMB.1.raw
  modified_base (287)..(294): a, c, t, g, unknown or other
  misc_feature (287)..(294): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgtcccaccctcctcacgtgatcgactgagcgggctggcaaggcgcatagnnnnnnnn

SEQ ID NO: 281101 - DNA, 587 bp, Homo sapiens
  misc_feature: GYAE6OF01ALEIO.38.38.D05.1.454.CMB.1.raw
  modified_base (518)..(518): a, c, t, g, unknown or other
  misc_feature (518)..(518): n is a, c, g, or t
tcagtcgatcacgtcacgaccggtgctcgatttagtatctgatagttgggtttgggggctttgcctgggctctgctgctcctcaccctcctcactcagggcacagggtcttgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggcccctcgacggggtttctactcgcttctcgtcggctcaagtttgcaacaccgcctcctcgacctatttcgtgggctccgaggctggacggacgaggtctaggtaattttagtcgtcttcctctagtactacgagtacacgtcagccctacccctttatcgttacgttccggaacgttcgggaccgtaaggtccacccgttacctaccgtcgaccgcccaaccggacccaacccnctctcctacctcctccgtacccctaccctccctccgaccgttagtacctaccgacgtgcggtccggtcg

SEQ ID NO: 281102 - DNA, 305 bp, Homo sapiens
  misc_feature: GYAE6OF01EGVNW.38.38.D05.1.454.CMB.1.raw
  modified_base (295)..(305): a, c, t, g, unknown or other
  misc_feature (295)..(305): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtctacgtcagcccaaggccaaccccatgtcactctcgttccccgccctcctcacgtgatcgactgagcgggctggcaaggcgcatagnnnnnnnnnnn

SEQ ID NO: 281103 - DNA, 718 bp, Homo sapiens
  misc_feature: GYAE6OF01BYV5M.38.38.D05.1.454.CMB.1.raw
  modified_base (268)..(268): a, c, t, g, unknown or other
  misc_feature (268)..(268): n is a, c, g, or t
  modified_base (650)..(650): a, c, t, g, unknown or other
  misc_feature (650)..(650): n is a, c, g, or t
tcagtcgatcacgtcacgaccggtgctcgatttagtatctgatagttggagtttgggggctttgtctgggtctcctggacagtcgatcaccatctcctgcactggaagcagtagtgacattggtggttataactatgtctcctggtaccaacaacacccaggcaaacgcccccaaactcatcatttatgacgtcactcatcggccctcacgggtttctactcgcttctctggctcctaagttcgcacacggcctcctgaccatttcgnggctccaggctgaggacgaggctcgtaattttatgccttccgtactataatacgacggtcacgccgagtacctaccccgttagtcggttccttacgggaacttcgggaacctaaagggtcctaccggtcccgtaacgtcgaaccgccccgtaaacgggtcccctaaacccccgtacgttacgttacccgtaacccgtttccgttaccccgggttaacccccctacccccgggtttacccttaccccgtaaacccgggttggtaaaaccgttcccggtaacccgggtttacggaaccgggggttcccggggtttaccgtacggggacccgttaaacgggggcccctaagtacgtttaacgggcctaaggtcaacctgggtccncgtacctcgtaacggctacgacgtcgacgtacgtcgacgtacgacgtacgtacgagtctcgtcgtacg

SEQ ID NO: 281104 - DNA, 565 bp, Homo sapiens
  misc_feature: GYAE6OF01AK0XY.38.38.D05.1.454.CMB.1.raw
  modified_base (449)..(449): a, c, t, g, unknown or other
  misc_feature (449)..(449): n is a, c, g, or t
  modified_base (529)..(529): a, c, t, g, unknown or other
  misc_feature (529)..(529): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (545)..(547): a, c, t, g, unknown or other
  misc_feature (545)..(547): n is a, c, g, or t
  modified_base (549)..(550): a, c, t, g, unknown or other
  misc_feature (549)..(550): n is a, c, g, or t
  modified_base (553)..(565): a, c, t, g, unknown or other
  misc_feature (553)..(565): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaacgcccccaaactcatcatttatgacgtcactcatccggccctcgtaggggtttctactcgctttctctggctcctaagtttggacaacgaccggcctccctgacctattttctggggccttccgaggctggaggacgaggctgtaattttatgctctcatactacgaggcagcagccctacccttatcgttctcggaactcggacctacggcaccgtcctacgtcacgcccgaacggaccccaaccccgtactcgtccaaccgttccttaccgggttccccccncccttccgtcctaccggttgaacctcgtaccgtcgggacggtccgggcgtcgggacctaacggggccacgtaagttcggncgtcgcgancngcncnnncnngcnnnnnnnnnnnnn

SEQ ID NO: 281105 - DNA, 312 bp, Homo sapiens
  misc_feature: GYAE6OF01DDSJC.38.38.D05.1.454.CMB.1.raw
  modified_base (292)..(292): a, c, t, g, unknown or other
  misc_feature (292)..(292): n is a, c, g, or t
  modified_base (299)..(312): a, c, t, g, unknown or other
  misc_feature (299)..(312): n is a, c, g, or t
tcagtcgatcacgtcacgaccggtgctcgatttagtatctgatagttgggttttggggtttctactcgcttctctggctccaagtttggcaacacggcctccctgaccatttctgggctccaggctgaggacgaggctgaattttattgctcctcatatacaggcagcagccaccccttatgtcttcggaactgggaccaaggtcaccgtcctacgtcagcccaaggccaacccatgtcactctcgtcccacctcctcacgtgactcgactggacgcgggctggcaaggccncgatagnnnnnnnnnnnnnn

SEQ ID NO: 281106 - DNA, 639 bp, Homo sapiens
  misc_feature: GYAE6OF01BLFSL.38.38.D05.1.454.CMB.1.raw
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (608)..(608): a, c, t, g, unknown or other
  misc_feature (608)..(608): n is a, c, g, or t
tcagtcgatcacgtcacgaccggtgctcgatttagtatctgatagttgggtttgggggctttgcctgggctctgctgctcctcaccctcctcactcgaggcacagggtcctgggcccagtctcgccctgactcagcctgcctccgtgtctgggtcctccgtggacagtcgatcaccnttcncctgccacgtggaacgctagtgtgactagtttggtagttataactntcgtctcgtacgtaccaacaccaccgagactaaaccgacccaactcatctattactgtacgtcnctcncgtccgtcctcggttacgggtttactcgtcgtcttctcgtcgtcctaccgtagttcggacctacgaccgtcctccgtcgtactacgttcgcggtcccgcgacgtcgacggacggtacgaggtcgttagttaaatttctcgtacctccttaatcttacgtacgtagtccgactcaacgtaccctttacccgttgttcgtacccgttacggtacgtacgggaacgtacgtccgtaccttccgcgtacaccggaccgacccggacccaacctgtccgtacctaccttccgtccctacccctcccgttcctaccggnttaccgcgtacgtggcgtcgggtcgtaccgg

SEQ ID NO: 281107 - DNA, 727 bp, Homo sapiens
  misc_feature: GYAE6OF01BECDG.38.38.D05.1.454.CMB.1.raw
  modified_base (192)..(192): a, c, t, g, unknown or other
  misc_feature (192)..(192): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctccgtggacagtcgatcaccatctcctgcacgtggaancagtagtgactagttggtagttataactatgtctccgtggtaaccaacaacaccgaggaccaaacgccccaaatcaatcgtatttatgacgtcactcactccggccctacgtacggggtttctactcgtctttctctcggcttaccgtaagtttcggacctaacgaccggtcccttccctaggtaaccctagtttcgtcgggtcctccgaggtcctaggacggtacgaggtcgttagtaaagtttttacgtcgacctttccttacgaattacgaacgtaggcaacgcgtaacgacccttaccccgtttatccgtttaccgttaccgggtaaacgttaccggggaaccctaaacgggttcccgtaacccgggtttaccctaaccgggttaccaaccgggtaaccccccgaaagggtacccccaaacccgtcgttaaccgtcccgtaaaccctttccgtacccgtttcccccgaccccgttcccgtaccgtaaacccggtcgtacgttaccgaccgttaggacccgtcgggggtacc

SEQ ID NO: 281108 - DNA, 609 bp, Homo sapiens
  misc_feature: GYAE6OF01DTHB4.38.38.D05.1.454.CMB.1.raw
  modified_base (347)..(347): a, c, t, g, unknown or other
  misc_feature (347)..(347): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggacaaacgccccaaactcatcatttatgacgtcactcatcggccctcgtagggtttctactcgcttctctggctcaagtttgacaacacgcctcctgacattcnggctcgagctgaggacgaggctagtaacttttatgacttcctcatatacaggcagacacgtacctaccccgttatcgttacgttcggtaacgtcggggaacctaacggtacctacccgtacccgttaacgtcgacgaccccgaacggaccccaaaccccgtaacttcgtaccctacgttcccgtaccgtttccccccgtcccctttcccgtaccgtaccggttacgtacgttaccgaccttagggaccggcggggtacccgg

SEQ ID NO: 281109 - DNA, 836 bp, Homo sapiens
  misc_feature: GYAE6OF01CLDX7.38.38.D05.1.454.CMB.1.raw
tcagtcgatcacgtcacgaccggtgctcgatttagtatctgatagttggggtttgggggctttgcctgggctctgctgctcctcaccctcctcactcagggcacagggtcctgggcccagtctgccctgactcagcctgcctccgtgtctggtctcctggacagtcgatcaccatctcctgcactggaagcaagtagtgactagttggtggttaataaactatgtcctcgtaggtacccaaacaacacccgaggaccaaaacgaccccaaactcaatactatttatgactcactcacgtcgtccctacgtacgggtttactactccgtcgttctacgtggcctaccgtaagtttcggacaacgtaaccggtccctacccgtacgtaacccttaacgttttccgtacggggtacccgtaccgtacgggtacgtacgggtaacggggtaaaccggaaggtcgttaaacggtttaaacgttttttaacgtttacggtacccttaacctttacctaacttaacggttaaaccgaacgggtaaccgtaacgtaccgtaaccggtaaccctaaacccccgtttaaggtttccgttaaccgttttaaccgggaaacccgggttacgggtaaacccgtaaacggttacccgtaacccggtttaccccgtaaccgttaccgaaccggttaacccccgaaaccggtacccctaaaacccccgtacgttaccgttaccctacccgttaccccggttcccgtttacccccgggtaccccttaaccgttacccgtaaccggtttacgaccggtttacggaccgtttaaggaccgggtaccgggtacggg

SEQ ID NO: 281110 - DNA, 710 bp, Homo sapiens
  misc_feature: GYAE6OF01E263G.38.38.D05.1.454.CMB.1.raw
  modified_base (135)..(135): a, c, t, g, unknown or other
  misc_feature (135)..(135): n is a, c, g, or t
  modified_base (189)..(189): a, c, t, g, unknown or other
  misc_feature (189)..(189): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (321)..(321): a, c, t, g, unknown or other
  misc_feature (321)..(321): n is a, c, g, or t
  modified_base (476)..(476): a, c, t, g, unknown or other
  misc_feature (476)..(476): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
  modified_base (708)..(708): a, c, t, g, unknown or other
  misc_feature (708)..(708): n is a, c, g, or t
tcagtcgatcacgtcacgaccggtgctcgatttagtatctgatagttgggttgggggctttgtctgggtctcctggacagtcgatcaccagtctcctgcactggaagcagtagtgacattggtggttataactangtctcctagttaccaacacacccaggtcaaagcccccaaactcattcattttangacgtcactcatcggccctcgaggggtttcctacgtcgcttctctggctccgagtttcgcaacncggcctcctgaccnttcncggctccgaggcctggaggacaggcttaggtaattttactcgccttcctnagtacgtacgagggtcacggtcgacgaccttaaccccgtttagtcggttaccgttacgggaaacttcggggtaacccaaagggttcccaacccggtttcctttaaaccggtcgtaaccggtaccccgtaaaacgggtccccctaaaaccccccgngttacgtacccaacgtttcccgtccggttaccccccggtaccccttccgtttaccgaaccggtttcgaacgttccggaaccttgggaaacgtcccgggggtacttacggggaccgtaacgggtccgacctaaggtccgtatccganacgtcgtanaccgcgtacgtacgagaccgcgtacgtagtaccaggttacctggacctaacgtcggtaagtccgtacggtacgttcncg

SEQ ID NO: 281111 - DNA, 736 bp, Homo sapiens
  misc_feature: GYAE6OF01CNUDV.38.38.D05.1.454.CMB.1.raw
  modified_base (269)..(269): a, c, t, g, unknown or other
  misc_feature (269)..(269): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcatcaccatctctgcactggaagcagtagtgacagttggtgttataactatgtctctggtaaccaacaaccaccaggacaaacgacccaaactcatctatttangtacgtacactcactccgccctgtacgggtttctacgtcgtcttctctggtcctacgtaagtttcggacctaacgaccggcccttacctacgtaccttagtttccgtcgggtcctaccgaggtcgtaggacgggaccgtagggtctaggtttaaattttacgttcgtccttacctagtaattacgtaaacgcggtacacgtacgacgtaccctaccctttaagtcgttaccgttaccgggtaacgtccgggtaaacctaacgggttacccaacccgtttacccgtaaccggttccgaacccggtaccccgtaaacccgggacccctaaacccccgtacgtttaccggtaccccttaaccgtttcccgttaaccccggtttccccccgtaccccgttcccctaccgtaacccgttacggtaccccgttaacggacccggttacgggtaacccggtccgggaacccggg

SEQ ID NO: 281112 - DNA, 657 bp, Homo sapiens
  misc_feature: GYAE6OF01A56OO.38.38.D05.1.454.CMB.1.raw
  modified_base (607)..(607): a, c, t, g, unknown or other
  misc_feature (607)..(607): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcaccatctcctgcactggaagcagtagtgactagttgggttagttaataacttatcgtctccgtaggtaacccaacaaccaccgaggaccaaacgcccccaatcatctatttatgacgtcactcagtccggcctcgtacggggtttctactcgtcttctcgtggtctacctagtttcgacaacgacggcctcctgacctagtttccgtaggtcctccgacggtcgtacggaggtacggagtcgttaggttaattttacgttcgtccttacctacgtatacgtacgtacggacagtaccgaccgtccctaacccgtttgttacgttaccgttaccgggaacgtacgggtaacctacggtcccgtaaccgttccctacgtccgaaccgcccgaaccgaccccaaacccgcttacgtcctaccgtcccgttcccgttccccncccttcccgccgtaccgtgtacctaccggacgttcggacgtcgggtaccg

SEQ ID NO: 281113 - DNA, 627 bp, Homo sapiens
  misc_feature: GYAE6OF01C65JT.38.38.D05.1.454.CMB.1.raw
  modified_base (218)..(218): a, c, t, g, unknown or other
  misc_feature (218)..(218): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctgggtcctcctggacagtcgatcaccatctcctgcacgtggaagcagtagtgacatttggtgttataactntcgtctcctaggtaaccaactaaccaacccgaggaccaaaaccgccccaaaatcaatctaatttactgtactcactccatccggccctgtacgggtttcctacgtcgtcttctctggtcctacgtaagtttgacacaccggcctcctagactattcgnggctcgagctaggacgacgtagtntagttatttacttcgccttcctacgtatactacgagtcaacgacacgacccttacccttagtcgtaccgttacggaacgtacgggaacctaacggtccctaacccggtaccgttaacgtccaaccggacccaaccggtacccaaccctacgttcacctcgtacccgtccgttacccccgccttaccctacgaccgtcgtactacgtctacggacggtcggtaaccgg

SEQ ID NO: 281114 - DNA, 730 bp, Homo sapiens
  misc_feature: GYAE6OF01CKCYL.38.38.D05.1.454.CMB.1.raw
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttgggtgttaataaacgttattgtctcctggtacccaaacaaccacccaggccaaaacgcccccaaactcatcatttatgacgtcactcacgtccggccctcgtagggtttcctactcgccttctcgtgcctctagtttcgacaacncggcctcctgacctattcgtgggctaccgagctggacgacgagcttgtaattttntgccttcctactagtaactacgacggtcagtcaagccctaacccgtttataccggttccgttaccgggtaaccgttaccggggaaccctaacgggttccctaaccccggttacccgttaaccgggtacccaacccggtaccccgaaaacccgggtcccccctaaaacccccgtaccgttaccgttaccccgtaacccgtttccccggtttacccgtttacccccccctacccccgttttaccccgacccggttaaacccggttacgttaaacccggttccccgtaacccggttaccgggtaacgggtccccggggttaacccggg

SEQ ID NO: 281115 - DNA, 574 bp, Homo sapiens
  misc_feature: GYAE6OF01BL0BX.38.38.D05.1.454.CMB.1.raw
  modified_base (451)..(451): a, c, t, g, unknown or other
  misc_feature (451)..(451): n is a, c, g, or t
  modified_base (514)..(514): a, c, t, g, unknown or other
  misc_feature (514)..(514): n is a, c, g, or t
  modified_base (545)..(545): a, c, t, g, unknown or other
  misc_feature (545)..(545): n is a, c, g, or t
  modified_base (564)..(564): a, c, t, g, unknown or other
  misc_feature (564)..(564): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggacaaacgccccaaactcatcatttatgacgtcactcactcggccctcgaggggtttctactcgtcttctctcggtctccgtaagtttggacaaccacggtccctccctgaaccctatttccgtgggcctccgaggcttaggacgggacgaggtacttgtaatttttagtcgccttcctcaattactacaggcagcagcctacccttntcgttcttcggaactcgggacctaaggtcctaccgtcctacgtcacgacccaagcccaacccnctcgtccactcgtccgttccccgccttcccnctacgtcgactcgacgcgnggtcggtccg

SEQ ID NO: 281116 - DNA, 532 bp, Homo sapiens
  misc_feature: GYAE6OF01BWICU.38.38.D05.1.454.CMB.1.raw
  modified_base (206)..(206): a, c, t, g, unknown or other
  misc_feature (206)..(206): n is a, c, g, or t
  modified_base (268)..(268): a, c, t, g, unknown or other
  misc_feature (268)..(268): n is a, c, g, or t
  modified_base (339)..(339): a, c, t, g, unknown or other
  misc_feature (339)..(339): n is a, c, g, or t
  modified_base (482)..(482): a, c, t, g, unknown or other
  misc_feature (482)..(482): n is a, c, g, or t
  modified_base (507)..(507): a, c, t, g, unknown or other
  misc_feature (507)..(507): n is a, c, g, or t
  modified_base (509)..(532): a, c, t, g, unknown or other
  misc_feature (509)..(532): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctnaggggtttctactcgcttctctggctccaagtttggcaacacggcctccctgacctatttcngggcctccgaggctggaggacgaggctgtaattttatcgctcctcatatacaggcagcagccctacccttntcgttccgtacggaactacgggacctaaggtccaccgttcctacgtcgacgaccccgtaacgaccccaacccactcgtaccacttacctccggttcccccgccctaccgtctacgtcgactccggacttacggcggccgggtntacgggacgaacggcgactagtcgncnnnnnnnnnnnnnnnnnnnnnnnn

SEQ ID NO: 281117 - DNA, 713 bp, Homo sapiens
  misc_feature: GYAE6OF01DCP8V.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctcctaggaaccaacaacaccaggcaaaacgccccaaatcatctatttatgacgtcactcactccggtccctcgtaagggtttctaccgtcgtcctttctccgtggccttacgtaaagtttcggaccaaaccgaccgggccccttccctacggtaaccctacgttttcgtcggggtccgttaccgaagggtccttaggagggaacgtacggtctaggttaattttacgtcgtccttcctactataacgttacgaggacaagctaaccgcctaacccgttatcggttacctttacgggaacttaccggggaaactaaccggtccgtaaccccgttacccgtaccgtacccgtaacggaacccccgtaacgggtaacccccaaaccccgtacgtcggttaaccctaccgttacccgttcccgttacccccggtccccttcccgtccgttaaccggttctaacgaccggtaactcgggaaggtcccggggtaacgg

SEQ ID NO: 281118 - DNA, 696 bp, Homo sapiens
  misc_feature: GYAE6OF01CKJHN.38.38.D05.1.454.CMB.1.raw
  modified_base (169)..(169): a, c, t, g, unknown or other
  misc_feature (169)..(169): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (632)..(632): a, c, t, g, unknown or other
  misc_feature (632)..(632): n is a, c, g, or t
  modified_base (667)..(667): a, c, t, g, unknown or other
  misc_feature (667)..(667): n is a, c, g, or t
tcagtcgatcacgtcacgaccggtgctcgatttagtatctgatagttgggtttgggggctttgcctagggctctgctgctacctcaccctcctcactcgagggcacgagggtcctgggcccagtctcgccctgactcagtcgtgcctcgtgtcgtgggtctcgtggacngtcgatcaccatcctcctagctacgtgggaacncgaggtgtgaacctgttcggtgttaanaactgtcgtcctacgtacggtaaccaaacgaccgacccgaggacctaaaacccggccccaaactctaactactaagtttacgacgaccgtacaccgtacgtacgtccggtccctacggttacgggtttctacgtcggtcttcgtcgtcggtcctacgttaagttcgactaacgccggtccctacgtacgaccttacgttcgtacgggtcctacggacggtcgtacggaacggacgtacggtcgttagtttaactttacgtccgtccttactaacgtacttaacgtcggaacggtctaacgacgtacctacccgttacccttgtcgttacggtaccgaacggtacgggaacctacggttcccaccggttcgacgtccgacggtaacccgacgtacccaaccgtntccgacctcgtcccttccgtccctaccctcgtacncgttacgctacgacgtcgcgtccggtacg

SEQ ID NO: 281119 - DNA, 572 bp, Homo sapiens
  misc_feature: GYAE6OF01BMS5W.38.38.D05.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (371)..(371): a, c, t, g, unknown or other
  misc_feature (371)..(371): n is a, c, g, or t
  modified_base (515)..(515): a, c, t, g, unknown or other
  misc_feature (515)..(515): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttataactntgtctcctaggtaacccaacaacncccgaggccaaaacgcccccaaatcatcatttangacgtcactcactcggccctcgtaggggtttctacgtcgtctttctcgtcggctaccgtagtttggccaacaccggcctccctgtacctagtttcgnggggtcctccgaggtctggacggacgaggtctagtaatttttactggtcctcctcatactacgaggtcagcacgcctacccttagtcgtctacggactgggacctaagtccaccgtctacgtctacgacccacggcccaacctntcgtccactccgttcgtcccgccttccacgcgttcgacttcgactcggaggcggtcg

SEQ ID NO: 281120 - DNA, 922 bp, Homo sapiens
  misc_feature: GYAE6OF01DUR22.38.38.D05.1.454.CMB.1.raw
  modified_base (217)..(217): a, c, t, g, unknown or other
  misc_feature (217)..(217): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcatcaccatctcctgcactggaagcagtagtgacagttggtgttaataactntgtctcctaggtaacccaacaaccacccgaggaccaaaccgacccccaaaactcaatcctaatttatacgacgtcactcatccggccctcgtaggggtttcctacgtccgtcttcctctcggccttcctaaggtttcggaccaaccgaccgggtccccttccccgtgtaccctaacgttttcgtcggggtcctcccgtagggtccgttacgggaacgggtaccggtagggtaccttaggtttaaactttttaacgttcgtaccctttacccgttaccttaaactttacgttaaaccgacgggtaccgtaacggtaaccgtaacccggtaccccttaacccccgttttaagttacccggttttacccggtttaacccgggggtaaaacccggtttaccgggggtaaacccccgttaaacggggttacccccgttaaccccccggttaccccgtttaaccgggtaccccgtaacccgggaccccccgtaaaacccgggtaccccccccgaaaaccccccgtttacccggtttacccggttaaaccccttaaccccgttttaccccgtttacccccggtttaccccccccctaacccccccgttttacccccgttaacccggttaacccgggtttaacccgtaacccggtttaacccggttaccccggttaacgggggtaccccggggtccggggttaacccccgggg

SEQ ID NO: 281121 - DNA, 739 bp, Homo sapiens
  misc_feature: GYAE6OF01C0NMJ.38.38.D05.1.454.CMB.1.raw
  modified_base (224)..(224): a, c, t, g, unknown or other
  misc_feature (224)..(224): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcaaggtagtgactagtttgggtgttaataaactntcgttcctccgtaggtaacccaacaaccacccgaaggccaaaaccgaccccaaactcaatcatttatgacgtacactcacgtccggccctcgtacggggtttcctactccgtcttctctcggtctacctagtttcggacaacgaccggtccctccgtacgtacccttacgtttccgtacgggccctaccgtacggtccgttagggaacggggtaccggaacgggtccgtttaaggtttaaaacgtttttacgttacggtccttaccctacctaaattacgttaaacgaggtaccgacgtacaaccgttcccgtaaccctttacgttacgttcccgttaacggtaacgtacgggaaccgtaacggtcctaacccggttaccttacgaccaaccgacccgtaaccggaccccaaaccctcgttactaccctaccgttcctcccgttccccggtaccccttcccgttccgtaaccggtcgtaccttaccgggtacttacgggccggtcggtacccggg

SEQ ID NO: 281122 - DNA, 483 bp, Homo sapiens
  misc_feature: GYAE6OF01A0X96.38.38.D05.1.454.CMB.1.raw
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
  modified_base (460)..(460): a, c, t, g, unknown or other
  misc_feature (460)..(460): n is a, c, g, or t
  modified_base (462)..(483): a, c, t, g, unknown or other
  misc_feature (462)..(483): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatccggcccctcaggggtttctactcgcttctctggctccaagtttggcaacacggccctccctgacctatttctgggcctccaggctgaggacgaggctgtaattttatgctcctcatatacaggcagcagcctaccccttatgtctacggactggaccagtcaccgtcacgtcacgcccaacgcccaacccntcgtcactcctcgtccccgcctcctcncgtgactcgactggacggccgggctcggacacggccacgatgntnnnnnnnnnnnnnnnnnnnnnn

SEQ ID NO: 281123 - DNA, 308 bp, Homo sapiens
  misc_feature: GYAE6OF01B1MIK.38.38.D05.1.454.CMB.1.raw
  modified_base (298)..(308): a, c, t, g, unknown or other
  misc_feature (298)..(308): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctcctcatatacaggcagcatcaccccttatgtcttcggaactgggaccaaggtcaccgtcctacgtcagcccaaggcccaacccactgtcactctcgttccccaccctcctcacgtgatcgactgacgcgggctggcaaggcgcatgcnnnnnnnnnnn

SEQ ID NO: 281124 - DNA, 711 bp, Homo sapiens
  misc_feature: GYAE6OF01ELYU8.38.38.D05.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctctggacagtcgatccaccatcctcctgcacgtggaancaggtagtgactagttggtgttaataactntgtcctccgtgtaaccaacaacacccgaggaccaaacgtcccccaaactcactctattatacgacgtcactcacgtccgcctacggtacgggtttctaccgtcgtcttcgtcgtcgtctacgtagttacgacaaccgtaccgccctacccgtacgtaccttacgtttcggtacggcctacggaggtcgtaggacggtacggtagtcgttaaggttaattttacgttacgtccgttaccttactaacgttacgtaacgtacggacgtaacgcgtaacccgttcccttaaccccgtttatccggttaccgttaccggaacgtaccggaccgtaacggtcccgtaccgtacccgtacgtacccgaccggtacccgaaaccggaccccctaaccctacgttaccgtaccctaccgttcccgttccccgtccccgtaccccgtccgtcccggtacgttacgtaccgtccgttaacgccgggtcggtcgggtccg

SEQ ID NO: 281125 - DNA, 584 bp, Homo sapiens
  misc_feature: GYAE6OF01EE8DD.38.38.D05.1.454.CMB.1.raw
  modified_base (190)..(190): a, c, t, g, unknown or other
  misc_feature (190)..(190): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (511)..(511): a, c, t, g, unknown or other
  misc_feature (511)..(511): n is a, c, g, or t
  modified_base (539)..(539): a, c, t, g, unknown or other
  misc_feature (539)..(539): n is a, c, g, or t
  modified_base (572)..(572): a, c, t, g, unknown or other
  misc_feature (572)..(572): n is a, c, g, or t
tcagtcgatcacgtcacgaccggtgctcgatttagtatctgatagttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaancagtagtgacattggtgttataactatgtctcctggtaccaacacacccaggacaaacgcccccaaactcatctatttatgacgtcactcactccggcccttgtaggggtttctactcgtcttctctgctctagtttgacaacncgcctcctgacctatttcnggcctccgaggtctggaggacgaggtcttagttaatttttagtcgtccttcctactaatacgtacgaggacacgacacgtccctaccccttatcgttaccgttacggacgtcgggacctacggtccaccgtcctacgtcacgcccaacgcccaacccnctcgtaccaccttccgttccgttccccncccttccctcgacgttacgactaccgagtcggnggtccgggtacg

SEQ ID NO: 281126 - DNA, 557 bp, Homo sapiens
  misc_feature: GYAE6OF01CMM8E.38.38.D05.1.454.CMB.1.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (337)..(337): a, c, t, g, unknown or other
  misc_feature (337)..(337): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
  modified_base (548)..(548): a, c, t, g, unknown or other
  misc_feature (548)..(548): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctgggtctcctggacagtcgatcaccatctcctgcactggaancagtagtgacagttggtgttaataactntcgtctcctaggtaaccaacaaccacccgaggcaaaacgccccaaactcatctattatgacgtcactcatccggcctcgtagggtttctactcgcttctctggctcgtagttcgacaacncgcctcctgacctagttcgtcgggtcctcgaggtctggacggacgaggtctagtaatttctcgctcctactatactacgaggcagcacgtcctacccttagtcgttcgtacgtaacgtcggaaccgaggtccaccgtcgtacgtcacgtacccacgcccaaccnctcgtcactccgtcgtccccncctcctcgacgtctctaccgactcgngtccggtcg

SEQ ID NO: 281127 - DNA, 773 bp, Homo sapiens
  misc_feature: GYAE6OF01CKXFQ.38.38.D05.1.454.CMB.1.raw
  modified_base (170)..(170): a, c, t, g, unknown or other
  misc_feature (170)..(170): n is a, c, g, or t
  modified_base (185)..(185): a, c, t, g, unknown or other
  misc_feature (185)..(185): n is a, c, g, or t
  modified_base (214)..(214): a, c, t, g, unknown or other
  misc_feature (214)..(214): n is a, c, g, or t
  modified_base (326)..(326): a, c, t, g, unknown or other
  misc_feature (326)..(326): n is a, c, g, or t
  modified_base (758)..(758): a, c, t, g, unknown or other
  misc_feature (758)..(758): n is a, c, g, or t
tcagtcgatcacgtcacgaccggtgctcgatttagtatctgatagttgggtttgggggctttgcctgggctctgctgctcctcacctctcactcagggcacagggtcctgggcccagtctgccctgactcacgctgcctcgtgtctgggtctctggacagtcgatcaccntctctgcactggaanctaggtagtgacagtttgggtagtttaanaacgttgttcgtcttccgtacggtaacccaaacaaaccgacccgagggtaccaaaaaccggtccccctaaactctattacctaatttacgtacggtaacgtcctacgtaccncggttccggcctacggtacggggtttacctacgtcgtcttcgtcgtcggtactctaagttcgaccaacaccggtcctaccgtacgtaccgtacgttacgtcggacgttaccgaagcgtacggacggtaacgacggtacgtagtttaacttttacgtcgttacctaccttacgtaacgttaacgtaacggtacggtaacaacggtaacctaaccggttaccctaacccgttttaagtaccgttaacgtttaacccgggtaaacggtacccggggtaaacaaccgggttacctaacccggttaccccgtaacggtaccgtacccggaacccgtaaccggacccaaccccgttacgtacgtcctaccgttaccgtccgtttaacccggcccctttacgaccggtaaccgttcgaaccgttaccgaggttaccggnggttcccgggtacgg

SEQ ID NO: 281128 - DNA, 649 bp, Homo sapiens
  misc_feature: GYAE6OF01E3HEK.38.38.D05.1.454.CMB.1.raw
  modified_base (373)..(373): a, c, t, g, unknown or other
  misc_feature (373)..(373): n is a, c, g, or t
  modified_base (523)..(523): a, c, t, g, unknown or other
  misc_feature (523)..(523): n is a, c, g, or t
  modified_base (624)..(641): a, c, t, g, unknown or other
  misc_feature (624)..(641): n is a, c, g, or t
  modified_base (643)..(643): a, c, t, g, unknown or other
  misc_feature (643)..(643): n is a, c, g, or t
  modified_base (645)..(649): a, c, t, g, unknown or other
  misc_feature (645)..(649): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaaccaacaacacccaggcaaacgcccccaaactcatcatttatgacgtcactcacgtccggccctcagggtagttttctaatccgtccttctctggctacccgaagtccgtcggaccaaccgaccggtcccctcccgttcggaacccattccttccgtcggggccttaccccgaaccgtcggaacggccgacggtccttaccgtacctttaatttagttcacgtaacncttacgaatactaacgacgccacggtccgtacggtacggttggggttcggttaccgggacggaaccgggacccgtacccgtacgggtaccgttccgttaacgggcaaccggtacccgacggtcccgtcccgtacccccggttggtacccncgttcccgttcccgttaccccctaccctaccctcggtaccgtgtaccgtaccgacgtcggacggtccgggtacgccgggaacgagtacgacgtacaggtcnnnnnnnnnnnnnnnnnncncnnnnn

SEQ ID NO: 281129 - DNA, 753 bp, Homo sapiens
  misc_feature: GYAE6OF01B2HMT.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctccgtggacagtcgatcaccatctcctgcacgtggaagctagtagtgactagttggtagttaataactatcgtcctcgtacgaaccaacaaccaccgaggaccaaaaccgaccccaaactcaacttactaatttagtgacgtactactacacgtccggtcctacggtacgggtttcctacgtcgtcttctacgtcggtctacgtagttcggacaaccgccggtccttcctacgtaccttacgttcggtcgggtacctcggacgtcgtaggaacggacggtagtacgttaacgtttagtttacttcgaccttccgtaactaacgttaacgacgtacggaccgtacgtacgaccctacccgttaacctttaggttaccggtttaccgttaacggggtaaaccggtaccggggtaaacccggttaccggtacccgtaaccccgttacccggtacgttacccgaaacccggaaccccgtaacccgaacccctaacccgtggttacccttacccgttaacccgtttcccggtcccgttacccccgtcccttccgacggttacctacgtacgttaccggtaacctcgggaacggtcggtaaccggg

SEQ ID NO: 281130 - DNA, 730 bp, Homo sapiens
  misc_feature: GYAE6OF01DJGJQ.38.38.D05.1.454.CMB.1.raw
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctgggtctcctggacagtcgatcaccatctcctgcactggaagcagtagtgacatttggtgttaataactatgtctctgaccaacacaccagacaaacgccccaaactcaatcatttatgactcactcactcggccctcaggggtttcctacgtcgtcttctctggtctctaagtttgacacaccggtcctcctacgacctatttcgtgggccttccgacggtcgtggacgggacggaggtctagttaaatttttgttacgtccgtttacccttcgtaaacttactaaaccgacggtacgaacgcgtaacccggacccttaccccctttaagttccgtttacgtttaacccgggtaaccgtacgggtaacccgtaacgggttaccctacccggttacccgtaacccggtacctaaccgaacccccggaaaccggtaacccccgaaccccgtaaacccgttccggtaccctacccgtttaccccgttaccggtttaccccccctaaccccgtttccccgtacccgtaacccggttacggtaaccgtacccggtaccttacgggccggttacccgggggtacccgg

SEQ ID NO: 281131 - DNA, 675 bp, Homo sapiens
  misc_feature: GYAE6OF01DRUEV.38.38.D05.1.454.CMB.1.raw
  modified_base (221)..(221): a, c, t, g, unknown or other
  misc_feature (221)..(221): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatcctcctgcacgtggaagcagtagtgactagttggtgttaataactntcgtctctagaccaacacaccagcaaacgcccaaatcatcatttatgacgtcactcagtccgcctcgtagggtttctactcgtcttctctggtcctacgtaagtttcggacaacgacggtccctcctgacctatttccgtggcctaccgacggctaggacggacggaggtaccgtagttaaatttttacgtcgtaccttccctactaattactaacgacgtcgagaccgtacgaccctaaccctttagttccgtacgtttaccggtaacgtacgggacctaacgggttcctaacccgttacccgtacggtaccaaccggttaccccaacgggacccctaaaccccgtacttccggtaccctaccgttccgttcccgttacccccgtccccgtttacccgacccgttacgtaccgtacgttacccgaccgtacgggtaccgggccgggtacccgg

SEQ ID NO: 281132 - DNA, 705 bp, Homo sapiens
  misc_feature: GYAE6OF01EQXHH.38.38.D05.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaancagtagtgactattggtgttataactntgtctcgtggtaaccaacaacacccaggaccaaacgccccaaatcatctatttatgacgtcactcatccggccctcgtagggtttctactcgtcttctcgtggctaccgtaagtttggacaacgaccggtccctccctgaaccctagtttcgtgggcctacgaggcctaggacggacgaggtacctaggttaatttttagtcgtaccgttacccttactaacgttaactacgacggactaacggacctacggtccctaacccctttaggttacgttccgttaacgggaaccgttacggggtaacccgtaacggttcccaacccggttaccctacggtacctaaccggacccctaacggaccccctaaaccccgtacgttaccggtaccctaacgtttcccgttacccggtttaccccccgtcccgtacccgtaccgtaaccggttacgtacccgttacggtaccgtcgggtaggtcccggtaccggg

SEQ ID NO: 281133 - DNA, 735 bp, Homo sapiens
  misc_feature: GYAE6OF01CJVSN.38.38.D05.1.454.CMB.1.raw
  modified_base (187)..(187): a, c, t, g, unknown or other
  misc_feature (187)..(187): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctctggacagtcgatcacatctcctgcactggaancaagtgtagactagtttggtagttaactaacttagtcgtcctccgtacggaaccaaacaaccaccgaggaccaaaaccgccccaactcatactaattagtacgtacgtactactacacgtccgtcccgtacgttacgggtttactaccgtcgtccttcgtacgtcgtctacgtaaggttcgaaccacgtaccgtccctaccgtacgtacctacgtttcgcggtcctaccgacggtacgtacggaaccggtaggtacggtacttaagtttaacttttacggttcttaccttcctacgtaactaacgtacgtacggacaacgtaacccgacgtacccctaacccgtttattccggttacgtaacccggtaagtaccggaaccttacgtaccgtaccgtaccgtacgtaccgtacccgaaccctaccggaccctaaacccgtcgttaccgtaccttaccgttccgttccccggttaccccctccccgtttaccgaccccgttagttaccgtacgtaacccggtagttaacgggaccgggtcccgtaacggg

SEQ ID NO: 281134 - DNA, 650 bp, Homo sapiens
  misc_feature: GYAE6OF01DJJT3.38.38.D05.1.454.CMB.1.raw
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtcctgccctgactcagcctgcctcgtgtctgggtctcctggacagtcgatcaccatctctgcactggaagcagtagtgacagttggtagttataacttagtgtcctccgtaggtaacccaaacaaccacccaggaccaaacgccccaaactcaatctattatgacgtcactcatccggccctgacgggtttcacgtcgcttctctggtcctcgtaagtttcgacaacnccgcctccgtnactcttcgtcggcctcgagtcgtgaggacgagtcttagtaatttcgtgccttcactaattanacgtacgcacgacacgccctaccctttagtccgttacgttaccggtaacgtaccgggtaaccctaacggtccgtaacccggttacccgtaaccgtccgaaccgacccgaacccgacccctaaaccccgtcctacgtaccctcccgttacccgtacccgtttacccccctaccccgttccctaccgtacgtaccggtacctacggtaccgtaggtcccggtcggggtaccg

SEQ ID NO: 281135 - DNA, 813 bp, Homo sapiens
  misc_feature: GYAE6OF01BECNV.38.38.D05.1.454.CMB.1.raw
  modified_base (108)..(108): a, c, t, g, unknown or other
  misc_feature (108)..(108): n is a, c, g, or t
  modified_base (137)..(137): a, c, t, g, unknown or other
  misc_feature (137)..(137): n is a, c, g, or t
tcagtcgatcacgtcacgaccggtgctcgatttagtatctgatagttgggttggggctttaggccgtgggctcgtgctgctccgtcaccctcctcactcgacggcacncgggtcctggcccacgtctgccctgactnacgcctgcctcgtgtacgtggtcactggactagtcgatcaccatcctccgtgcacgtcggaactcgagtaggtgactaggttggttacgtaataacgtattcggtcctaccgttaggtaaccaactaacacccggaaggacctaaaaacggtccccctaaatctaacttacgtaacttttagtcgaacggtaccaccgtactaacgtcccggtaccttacggtacggggtttacctaacgttccggttaccttacgtacgtcggtccgtaccgtaaagtttcggactaaacgccggtacccttccgtacgaccgttaatttccgcgggtaccttcgacgtcgtacggtagggaccggacgtccgtagttaaactttcgtctaccgttccgtaacgtacttaacggtaacgaacgggcgtaacggtacggtaaccggtaccgtaaaccctttcggtaacggtttcccgtttaaacggtacccgtttaacggggaaaacccttaacgggttccctaaccgttacccgttaccggtttaacccgacggtaaaccccgttacgaacccgtaaccccgtaacgttacgtccctaaacggttccctaccggtttacccccgaccgttcccgtaccgtacgtccgtaaccgtaccggaaccctacggtacccggtgggtcccc

SEQ ID NO: 281136 - DNA, 567 bp, Homo sapiens
  misc_feature: GYAE6OF01BI3VU.38.38.D05.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactattggtgttataactatgtctcctggtaaccaacaacacccaggaccaaacgcccccaaactcatcattatgacgtcactcatcgcctcgagggtttctactcgcttctctgctaccagtttcgacacgacgcctcctgacctagttctgggctcgagctggacggacgaggtctagtaattttagtcgtcgtcctactagtactacgaggcacgacacgcctaccccttatcgtcttacggtaacgtcggacctaaggtccgaccgtccgtacgtacgacgaccaacgacccaaccctactcgtctacctccgtccgttcccaccctccctactacgtcgtactacgacgtcgcggccggtacgg

SEQ ID NO: 281137 - DNA, 664 bp, Homo sapiens
  misc_feature: GYAE6OF01A25HZ.38.38.D05.1.454.CMB.1.raw
  modified_base (303)..(303): a, c, t, g, unknown or other
  misc_feature (303)..(303): n is a, c, g, or t
tcagtcgatcacgtcacgaccggtgctcgatttagtatctgatagttgggtttgggggagagaggagccttagccctggattccaaggcctatccacttggtgatcagcactgaccaccgaggattcaccatggaactggggctccgttgggttttccttgttgctattttagaaggtgtccagtgtgaggtgcagctggtggagtcgtgggggaggcctggtcaagccgtggggggtccctgagactctcctgtgagtctcgtggattcctccttcagttacttatagcatgaattgggccncagactccgaggggaagggctggagtgggtcgcattcatcagtactacgtgggatttcatattacgtacgcagacgtcggtggaacgggcctattccacctatttcccagtacgaaccaacgaccgaaaggtacgtacacgtagtactctagactaaagtcgggaacacgccctaggtacgttggtacccggaacggaaccgtaccgggtccgtttaggttacgttaactttacggtcggttcggtaccggtaacccggttccgtaaacccggggtaaaaagttccgggttttaaacgtaagttttaaggtacgggttaaacggttgaacgtttccgaaccgttccccccgggttacgggg

SEQ ID NO: 281138 - DNA, 809 bp, Homo sapiens
  misc_feature: GYAE6OF01AL1BB.38.38.D05.1.454.CMB.1.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcngcacgtagacgcagtgnacgtagttggtagttaactactagtcgtcctcgtacgaaccaaccaaccaccgacgaaccaaacccgaacccctaactcattactatttacgcgtaccgtacctacctactacgtccccggtaccccttacgggttaccggggttttacctacgttccgttcctttccgttcgtcgtaccgtaccgttaagggtttcggaacctaaccggtcccgggtccccttacccgtacgtaccgtttacgtttcgggtacgggcccttacggacggtccggtaaggaaccggggtacgacggttacgttaagttttaacgtttttcgtaccgtccttacctacttaattaacgtacgacggtcgaacgtccgtaccgtaccccttaaccgtttagtccgtttaccggttaacgggtaacccggtacggtaaacccgtaccggttaccccgtaccggttaccgtaccggtaccgaacccgtaccccgtaacccggaacccccctaccgttacgttccggaacccttaccttccggttcccccttaccccctccccgttcgtaacccgtcggttaaccgtacccgtacgtaaccggttcgggaccgggttccggtaccggg

SEQ ID NO: 281139 - DNA, 687 bp, Homo sapiens
  misc_feature: GYAE6OF01DUO2I.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgactagttggtagttaataactatcgtcttccgtacggtaaccaaacaaccacccgaggaccaaaaccgacccccaaaactcaattctaatttatcgtaccgtcactcacgtccggcccttcgtacggggtttcctacttccgtcctttctcgtcggtccttaccgtaaggtttcggaccaacgtaccggtccctccctcgtaccttacgtttcgtcgggcctccgaggtcgtaggacggacgacggtctagtttaattttagttcgtccttccgtactaattaagtacgaggtacacgacgacgtccctaacccgtttgtcgttccgttacggtaacgtacgggacgtaacggtccaccgttacctacgtccaccgtacccgaacggtaccccaacccgtctcgtaccctacgtcccgttaccgttaccccaccccgtttcacccggtacgtaccgtacttccggacttcggaccgggtcggtaccgg

SEQ ID NO: 281140 - DNA, 790 bp, Homo sapiens
  misc_feature: GYAE6OF01DYXYD.38.38.D05.1.454.CMB.1.raw
  modified_base (478)..(478): a, c, t, g, unknown or other
  misc_feature (478)..(478): n is a, c, g, or t
tcagtcgatcacgtcacgaccggtgctcgatttagtatctgatagttgggtttggggctttgcctgggctctgctgctcctcaccctcctcactcaggcacagggtcctgggcccagtctgccctgactcagctgcctccgtgtctggtctcctggacagtcatcaccatctcctgcactggaagctagtacggtgactagtttgggtacgtttaataaaccttatcgttcctccgttacggaaaccaaacaaaccgaccaaggacccaaaaaccgccccctaaaactccaactactaagttttatacggtaacctacaacttacaacgtccgggtaccttcggtacggggttttactaaccgtcggtcctttcctccgtacggtctaccctaaaggtttcggacctaaccgtaccgggcccttccccttagaaccctagttttccgacggggtccaccgtaggccgtaggacggagngggtactagttaactttttacgtctctacctactaataacttacgaggacttaaacggcaacgtacccgtaaaccccttgttaccggtttactaaccggttaaacggacgggttaaacccgaaacggttccgtaaaccccggttaccgtttaacgggtacccacggggaaacccccttaaacgggcccccgaaaaaccctcggttacgtacccgaaactttcccgtaaccggttaccccccaacccctttcggaccttaaacccgtgtaaccgttaccgtaaccggtttcggaaacgggttccgggtaaccg

SEQ ID NO: 281141 - DNA, 753 bp, Homo sapiens
  misc_feature: GYAE6OF01A1KGU.38.38.D05.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctggccctgactcagcctgcctccgtgtctgggtctcctggacagtcgatcaccatctcctgacactggaagcagtagtnacagttggtggttataactntgtctcctaggtaacccaaacaacgacccagggaccaaaacggtccccccaaaactcgtaactctaattttatcgggtaaccttacaacctccacgttccggacccctacggtaacgggggtttttccaccgttcggtcctttcctacgttcgggtccttaccgtaaagggtttcggacctaaaccggaccggtcccttacccctacggaacccgttacgtttcccgtggggtcccttaaccggacgggccttagggaacggacggaacggtccgttaaggttaactttttagttcgtacccttcctactattaacgtacgaacggctacggacctacggaccctacccttagttcgtccgtacggtaacgtcggaacctaacggtcctacccgtaccgtacgccgtaacgaccccgaacggtacccctaaacccgtccgtacgtacccaccgtttacccgtcccgttaccccctccctccctaccgtaaaccgttcgaaccgttaccgtaacggcggtaccggtccggtacgg

SEQ ID NO: 281142 - DNA, 631 bp, Homo sapiens
  misc_feature: GYAE6OF01BFTGZ.38.38.D05.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctcgccctgactcagcctgcctcgtgtctggtctcctaggacagtcatcaccatcctctgcacgtggaagcagtagtgatagttggtacgttaataactntcgtcctcctaggaacccaaacaaccaccgaggacaaaaccgtccccaaactcatctaatttancgtactacactacacgtccggccttcgtagggtttcacgtcgtcttctctaggctacctagttcgacacacgtccctccagtacctattacgtcgggcctcgacggtcgaggaggacgtaggtcttaagtaattttacgtctccttactacgtaatacgtaacaggacctagaccagaccctacccttagtccgttacgtacggtaacgaggtaaccaggtacccaaccggttactaccgtaccgtaacgaccctaaccggaccctaaccccgtntacnccgttactcgtccttacccaccctcctccgtacgtacgtacgtacgtacccgnggtaccgnggtaccg

SEQ ID NO: 281143 - DNA, 308 bp, Homo sapiens
  misc_feature: GYAE6OF01BOEJH.38.38.D05.1.454.CMB.1.raw
  modified_base (293)..(293): a, c, t, g, unknown or other
  misc_feature (293)..(293): n is a, c, g, or t
  modified_base (299)..(308): a, c, t, g, unknown or other
  misc_feature (299)..(308): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaatttttattgctcctcatatacaggcagcagcaccccttatgtcttcggaactgggaccaaggtcaccgtcctacgtcagcccaaggccaaccccactgtcactctcgttccccaccctcctcacgtgactcgactgagcgggctggcaaggcncatagnnnnnnnnnn

SEQ ID NO: 281144 - DNA, 641 bp, Homo sapiens
  misc_feature: GYAE6OF01AUYF0.38.38.D05.1.454.CMB.1.raw
  modified_base (264)..(264): a, c, t, g, unknown or other
  misc_feature (264)..(264): n is a, c, g, or t
  modified_base (517)..(517): a, c, t, g, unknown or other
  misc_feature (517)..(517): n is a, c, g, or t
  modified_base (613)..(613): a, c, t, g, unknown or other
  misc_feature (613)..(613): n is a, c, g, or t
  modified_base (616)..(641): a, c, t, g, unknown or other
  misc_feature (616)..(641): n is a, c, g, or t
tcagtcgatcacgtcacgaccggtgctcgatttagtatctgatagttggggtttgggggcttcgtctgggtctcctggacagtcgatcaccatctcctgcactggaagcagtagtgacattggtggttataactatgtctcctgtaccaacaacacccaggcaaacgcccccaaactcatctatttatgacgtcactcatccggccctcgtaggggtttctactcgtcttctctggctccgtagttcgcaacgccggcctcccngtacctatttcgcgggcctccgaggctggacggacggaggtctagttaattttatcgtccttcctactatactacgacggcaggacacgcctaccccttagtccgttacgttaccggaacggtaccgggtaaccgtaacggtccccgtacccgttacccgtaccgtaccgaaccggtaaccccgaacccggaaccccctaaaccccctacgttacccgtacccttacccgttcccttacccggtttccccccncccccgttacccgtaccgtaccggttcgaaccttccggtaaccggtcggaccgggtccgggtaccgtacgggaccaacgggtccacgtaacgtgancgnnnnnnnnnnnnnnnnnnnnnnnnnn

SEQ ID NO: 281145 - DNA, 813 bp, Homo sapiens
  misc_feature: GYAE6OF01AR77N.38.38.D05.1.454.CMB.1.raw
tcagtcgatcacgtcacgaccggtgctcgatttagtatctgatagttgggtttgggggctttgcctgggctctgctgctcctcaccctcctcactcgagggcacagggtcctgggcccagtctgccctgactcagcctgcctcgtgtctgggtctccgtggacagtcgatcaccatctcctgcacgtggaagcaggtagtgactagttgggtaggttaataacgttatcgttcctccgtacggtaacccaaacgaaccacccgaggaccaaaaccgacccccaaatcaacttcctaatttatacgacgtacactcacgtccggtcccgtacgtacggggttttctaccgtccgtccttcgtcgtcggtccttaccgtacggtttcggaccgtaaaccgtcccggtcccttcccgtacgtaaccgtttacgtttccggtacggggtacccttaccggaacggtccggtaacggacggggtaaccggtacggtaccgtttagggttaaactttttcgtcggtaccttccgtataacttacggtacgaggtacgaacgtccaaaccgtcccttaccgttacgttccggttacccgttacggtaaacccgggtaccgggtaaccgtaaccggtccccgtaaccgggttaccccgttaacggacccggtacccggaaccccgaacccgggtaccccaaaccccgtcgttacgtaccctaacccgttcccgtcccgttccccgtaccccgttccggttaacccgtcggttaacccgtccgggtactaccgggacccgggttcgggaccggtacccgggg

SEQ ID NO: 281146 - DNA, 623 bp, Homo sapiens
  misc_feature: GYAE6OF01E446J.38.38.D05.1.454.CMB.1.raw
  modified_base (376)..(376): a, c, t, g, unknown or other
  misc_feature (376)..(376): n is a, c, g, or t
  modified_base (552)..(552): a, c, t, g, unknown or other
  misc_feature (552)..(552): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcaccatctcctgcactggaagcagtagtgactattgggtgttaataactatgtctccgtaggtaccaacaccacccgaggaccaaaacgcccccaaaactcatactatttactcgacgtcactcacgtccggccctacggtacgggtttcctactcgtcttctcgtcggctacgtaagttcgacaacgaccggtcctaccgtgacctnttccgtcgggctaccgaggctaggaacggacgtaggtacttaggttaacttttagtcgtctacctactatactacgagcgacgtacacgtcctacccttatcgtactacggtacgtacggacctacggtccaccgtacctaccgtacgaacgtacccaacgaccccaaccctactntaccctactccgttcctacccctacccgtccctacgtacgtacgtactaccggactcggacggcgggtacg

SEQ ID NO: 281147 - DNA, 690 bp, Homo sapiens
  misc_feature: GYAE6OF01B72SF.38.38.D05.1.454.CMB.1.raw
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctggtctcctggacagtcgatcaccatctcctgcactggaancaagtagtnactattgggtagtttataactntgtcctcctaggtaacccaacaacacccgaggaccaaaacgtcccccaaactcattctatttagtgaccgtcaactcacgttccggtccccttcgtacggggttttacctaccttccgtccttccgtcgttggcctaccgtaaggtttcgacaaccgaccggtccctccctcgacccttatttccgtgggccttaccgaggtcgtaggacgggacgaggtcttagtaatttttgtcgtcctcctactataagtaacgacggacagcaccgtacccttaccccttagtcggttccgttaccggaacgtaccgggaaccgtaacgtccgtaacccgtaccgttaccgacctaccggaaccccgaacgaccccgaaaccctcgtccgtacctccttccgttcccgttccccccgtaccccttccgtacccgtacgttacgtaccgttaccgacggtcgtacgggccgggtacgg

SEQ ID NO: 281148 - DNA, 697 bp, Homo sapiens
  misc_feature: GYAE6OF01D6AJX.38.38.D05.1.454.CMB.1.raw
  modified_base (495)..(495): a, c, t, g, unknown or other
  misc_feature (495)..(495): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtagttataactatgtcctccgtacgtaccaacaaccaccaggacaaaccgacccccaaactcatctatttatcgacgtcactcactccggcctcgtacgggtttctacgttcgtccttctcgtcggtcctacgtaacgtttggacctaacgccggtccctccctacgtacctagtttcgtcgggtcctccgacggtccgtacggaacgggaccggaggttacgttacgggtttaaactttttcttaccggtccttacccgtttactaacttactaacggtacggaccncggacctacggccccttacctttagtcgttaccgttaccggtaacgtcgggtaacctaacggtccctaccggttcctacgtaccaccgtacccgaaccgaccccaacccgtacctacggtacctccgttaccgtccccggtttacccctaacccccttccaccgtacggtactaccgtaccgtagtccggcggcgggtaccg

SEQ ID NO: 281149 - DNA, 625 bp, Homo sapiens
  misc_feature: GYAE6OF01A6G7Q.38.38.D05.1.454.CMB.1.raw
  modified_base (151)..(151): a, c, t, g, unknown or other
  misc_feature (151)..(151): n is a, c, g, or t
  modified_base (262)..(262): a, c, t, g, unknown or other
  misc_feature (262)..(262): n is a, c, g, or t
  modified_base (595)..(595): a, c, t, g, unknown or other
  misc_feature (595)..(595): n is a, c, g, or t
  modified_base (600)..(603): a, c, t, g, unknown or other
  misc_feature (600)..(603): n is a, c, g, or t
  modified_base (605)..(606): a, c, t, g, unknown or other
  misc_feature (605)..(606): n is a, c, g, or t
  modified_base (608)..(608): a, c, t, g, unknown or other
  misc_feature (608)..(608): n is a, c, g, or t
  modified_base (610)..(614): a, c, t, g, unknown or other
  misc_feature (610)..(614): n is a, c, g, or t
  modified_base (616)..(617): a, c, t, g, unknown or other
  misc_feature (616)..(617): n is a, c, g, or t
  modified_base (619)..(625): a, c, t, g, unknown or other
  misc_feature (619)..(625): n is a, c, g, or t
tcagtcgatcacgtcacgaccggtgctcgatttagtatctgatagttgggtttgggggctttgtctgggtctcctggacagtcgatcaccatctcctgcactggaagcagtagtgacatcggtggttataactatgtctcctggtaccaanaaccaccccgccaaacgcccccaaactcatgatttatgaggtcagtaatccggcccgtcgggggtttctaatcggttctctggcctccaagtctggcaacgacggcctccngaccatctcgtgggcctaccagcctagacggacggagtctgtatttattactgcagctactataactacctagacagactagtctaacggttggggttacggttacgggggaccggggaacctaaaggccgtacggtaacccggttccgttaaggccgtaccggacccgaagggtcccgtacccggtccccccgtggtaccctaacggttccttcccgttacccccacccttcctaacccgtagttacggaaccgttacggtaccgttacgggcgggtacccgggtacgttacgggaccggaacggtcccgtaacgttaacgaggcaagcgtnaccgnnnngnncngnnnnncnnannnnnnn

SEQ ID NO: 281150 - DNA, 752 bp, Homo sapiens
  misc_feature: GYAE6OF01DHU6H.38.38.D05.1.454.CMB.1.raw
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctggtctctggacagtcgatcaccatctcctgcacgtggaagctagtagtgacatttggtaggttaataacttatcgtacctccgtacggtaccaaacaaccaccgaggaccaaaccgcccctaaactcaatcctaatttatacgtaaccgtactactccgacgtccggtcccgttacggttacggggttttcctaccgtccgttcctttcctcgtcggtaccttaccgtaaaggtttccggaacctaaccgacccggtcccttcccgtacgtacccttacgtttccggtcggtccttaccgacggtcgtagggacggacgtacgacgttaggtttaactttagttcgtccttacctactaacgtaacgtacggacgtacgaacgtaccacggtcccttacccgtttattccggttaccgttacgggtaaacggtacccgggtaaccgtaacggttcccgtaacccggttccgtaacccggtacacccggtaacccgaaccggacccccgaacccttacgtaccgtccttaccgtccgttacccgttccccccgtccttccgtacccgtacgtacgtcgtaccggtagcggacggtccgggtccgg

SEQ ID NO: 281151 - DNA, 594 bp, Homo sapiens
  misc_feature: GYAE6OF01C09BQ.38.38.D05.1.454.CMB.1.raw
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (274)..(274): a, c, t, g, unknown or other
  misc_feature (274)..(274): n is a, c, g, or t
  modified_base (359)..(359): a, c, t, g, unknown or other
  misc_feature (359)..(359): n is a, c, g, or t
  modified_base (460)..(460): a, c, t, g, unknown or other
  misc_feature (460)..(460): n is a, c, g, or t
  modified_base (551)..(551): a, c, t, g, unknown or other
  misc_feature (551)..(551): n is a, c, g, or t
tcagtcgatcacgtcacgaccggtgctcgatttagtatctgatagttgggtttggggctttgcctgggctctgctgctcctcaccctctcactcgaggcacgagggtcctgggcccagtctgccctgactcagtcctcgcctcgtgtcgtggtctcgtggacagtcatccacatctctgacactaggancagtgngatgttaggtataataactgtcgtcctacgtacgtaaccaacaccgccgaaggaccaaaccgtccccaaatcaacgttntaatttacgcgtaccgtcactctcgtccgaccgttggtacggtttactctcgtcttctcgtacggtctacgtagtacgaccgacnccgtacctctacgacttcgtcgcgctcgacgtcgaggaccggtagtcgtagttagttaattcgtcgccttacataatacgacgagccagccactcctactntcgtactagcgtacgactacggctacgtacccagcgaaccgcccgaacgcccaaccttgccaccttcctaccgtacccgtaccctacccgngtacccgtcgtacttcccgacgtagtcggcggtcgtaaccggg

SEQ ID NO: 281152 - DNA, 795 bp, Homo sapiens
  misc_feature: GYAE6OF01D4FP8.38.38.D05.1.454.CMB.1.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
tcagtcgatcacgtcacgaccggtgctcgatttagtatctgatagttggggtttggggctttgcctgggctctgctgctcctcaccctcctcactcagggcacacgggtcctggcccagtcctgccctgactcgacgcctcgcctccgtgtcgtcgggtcctccgtggactagtcgatcaccgtactcctcctgacacgtggaacgcagtagtcgactgttggtacgttanaactntcgtctcctgaaccaacaacaccgagacaaccgccctaacgtctactactaactttagtacgtaaccgtacctaaccgtctaaccgtcccggtccccttacggttacgggtttaccttaaccgtccgtccttaccgtcgttcggtaccttaacgtacggtttaccggacctaaccgaccggtccctaccgtactacccttcgtttccggcggtacccttacggacgttacgcggaacgggaccgtacgggtccttaagttagttttaacgtccgttaccttaccgtacgtaacgttacgtaacgggacgtacgaacggtccgtaaaccgtcccgttaaccgtttagccggtttaaccgtacgggaacttacccgggaacttaccgggtacctaacccggttcgtaaccgtacgtaaaccccgacccggttaaaccggccccctaaaccgtccgttacggtcccctaaacgtttccccgtacccgttccccaaccccgttcgtaccgtccggttaaacccgtaccgtaccggtaggcccgttacgggtccgggtaacccg

SEQ ID NO: 281153 - DNA, 683 bp, Homo sapiens
  misc_feature: GYAE6OF01CIFJL.38.38.D05.1.454.CMB.1.raw
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattgggtagttactaatntgtctcctggaccaacacacccgaggcaaacgccccaaactcatcatttangacgtcaactcatccggccctcgtaggggtttctactcgtcttctctggctctaagtttgacaacgacggccctcctgacctatttcgtcgggcctccgaggctggacggacgacgacgttgtaattttattcgcttcctcgtataataccgaggtacaagccacgtacctaaccccctttagtccggttcgttacccggtaacgtacggggtaacccaacggttcccgaacccgttcccgtacggtccgaaccggacccccgtaaagggcccccaaaaccccccgtcgttaccgtacccgtaaccgttcccgttcccggtttcccccggcccccctttcccgttacccgtacccggttacgaaccggttaccccgggtaccttccggggtaaccggtcccgggggttaaccgg

SEQ ID NO: 281154 - DNA, 629 bp, Homo sapiens
  misc_feature: GYAE6OF01BCN56.38.38.D05.1.454.CMB.1.raw
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
  modified_base (421)..(421): a, c, t, g, unknown or other
  misc_feature (421)..(421): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctccgtggacagtcgatcaccatctcctgcactggaaccagcagtgacgttggtggttataattgtctctgtaccangcaccggnaatcgacccaaatcatgtatttangacggtcactcacgtccggcccttcgtaggggtttactaacgtcgtcttctcgtcgctactacctaagtcgtaggaccaaccgtaccggtccctaccgtacgaccacttcgtccgtcgggcctacgaggtcgtagacggacgtagtctaattacgttcngtactagtactatacaacacctagacaactactgtacgtacttcgttacgggacggtaacgggactaagtcgttaccgaccggttaccgtaacgtccgaccgaccgaacggtccgtacccgtccccgttacgtacctccgttaccgttaccctccccgaccccttccgacccgttacgtacgtaccctccggtacgtgggtacccggg

SEQ ID NO: 281155 - DNA, 730 bp, Homo sapiens
  misc_feature: GYAE6OF01A6RUQ.38.38.D05.1.454.CMB.1.raw
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcacatctcctgcactggaancagtagtgactnttggtggttataactatgtctcctaggtaccaacacacccgaggcaaaacgtccccaaactcatcatttatgacgtcactcagtcgcctcgagggtttcactcgtcttctcgtgtctacctagtttcggactaacccgcggtcctcccctaggtaccctagtttcctggggccttccggaggtctacggaacggaccggagggttcctagggtttaaactttttacgtcggtcccttaccgttacctaagtttaactaaccgaccggtacgtaacggacctaacggtacccttacccccgtttaagttccggtttaccgttacgggtaacggtacggtaacccgtaacgggttacccgtaaccgttacccgtaccggttaccgaaccgtaacccgaacccgggttaccccaaaaccccgttaccgtcttacccgtaaccttcccgtaaccggttccccctacccctttacccgacgttacccgtacgttaccgtaccctacggtaccggtacggtcccggggtaaccgg

SEQ ID NO: 281156 - DNA, 737 bp, Homo sapiens
  misc_feature: GYAE6OF01A3D46.38.38.D05.1.454.CMB.1.raw
  modified_base (433)..(433): a, c, t, g, unknown or other
  misc_feature (433)..(433): n is a, c, g, or t
tcagtcgatcacgtcacgaccggtgctcgatttagtatctgatagttgggtttgggggagagaggagccttagccctggattccaaggcctatccacttggtgatcagcactgaccaccgaggattcaccatggaactgggctccgttggtttccttgttgctattttagaaggtgtccagtgtgaggtgcagcgtggtggagtcgtgggggagcctggtcagccgtgggggtcctgagactctcctgtagagtctctggtattcctccttacagttacttatagctatagtaagttcgggtcccgaccgacgaccgtaccggaagggggaacggggcgtagggtacgggttcggggtccgctacgttacgattaccgtaagttaaccgttaacggtgggttaacttttacgaagttaacgttaacgtaccgngtaacggtacgttcgggacgtaacgggccgtacttacccgtaccgtactttaccgaagtaacgaaaccaacggtaaccgaaaggagtaccgaattcgtaatcgtagtaactaaagtcggactacgtcctaggtacgtcgtacgaccgaccgtacggtcttacggttagttaacgttacgtcggtaccgtacggtaaccggttaacccggtaaaccgggttaaaaccgtttggtttaaacgtaagttttaacggtacgggttaacgtacgttaaccgttccgtaacccgttccccgttaaccggg

SEQ ID NO: 281157 - DNA, 780 bp, Homo sapiens
  misc_feature: GYAE6OF01BMKSM.38.38.D05.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (618)..(618): a, c, t, g, unknown or other
  misc_feature (618)..(618): n is a, c, g, or t
  modified_base (695)..(695): a, c, t, g, unknown or other
  misc_feature (695)..(695): n is a, c, g, or t
  modified_base (775)..(775): a, c, t, g, unknown or other
  misc_feature (775)..(775): n is a, c, g, or t
tcagtcgatcacgtcacgaccggtgctcgatttagtatctgatagttgggtttgggggctttgcctgggctctgctgctcctcaccctcctcactcagggcacgagggtcctgggcccagtctcgccctgacctcgagcctgccttccgtgtcgtcgggtcctccgtggacagtcgatccacctatcctccgtgactacgtgggaacncgtagtcgtagacgtagtttggtacgtttaataactntcgttcctacgtacgaaccaacaccaccgacggacaaccgcccaactctactactagttacgactacgtacacgtacacgttcccgacgttcgttacggttctccgtcgtcgtttcctacgtcgtacctacgttaggttaccgaccgtaaccgtcccggtcccctcgtaccgtacttacgtttccggacggtcctacggtcggacgtaggacggtacgtcgttacgttaattttaccgttttctcgtacccttacgtacgtaacgttaacgcgggtacgaaccgtacgtacccggaaccttacccgttacccgtttaagtcccggtaaacccgtcggaaaacccgggtttcggaaacccgtccggttaacccnccgtttaacccggcgttaccccgaaccgtaccccgtaacccgtaccccacccgtttacggcctaccggtttaccccncccgtttccccgaccccggttcccttaccggcccggttaacctcggtaccccgaccggttggaccgggtcgggttacccncgggg

SEQ ID NO: 281158 - DNA, 651 bp, Homo sapiens
  misc_feature: GYAE6OF01AE8UR.38.38.D05.1.454.CMB.1.raw
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagtcgatcacgtcacgaccggtgctcgatttagtatctgatagttgggtttgggggctttgcctgggctctgctgctcctcaccctcctcactcagggcacgagggtcctgggcccagtctgccctgactcagcctgcctccgtgtctgggtcctcctggacagtcgatcaccntctcctgcacgtggaagcagtagtgactagttggtgttaataactntcgtcctcctacggaaccaacaaccacccgaggaccaaacgacccccaatcatctattatcgacgtcactcactccggccctcgtacgggtttcctacgtcgtcttctcgtgtctctagttcgacacgccgcctcctgacctnttcgnggctcgngctggacggacgtacggctacgtacttagttactgacacgtcgtactaatactaacgagcgtaagtcccgtcgttacgggttcgggttacggtccgggagggaaccggtacccgtaccgtaccggtccggtcgttacgggtaccaccgggaccgtaccgggtccctacccggtcccgtacgttacccgtaccgtccgttacccgttaccccctccgttccccgtaccgtaccgttacgtaccgttccgaacggtcggtccgggtcggtacccgg

SEQ ID NO: 281159 - DNA, 741 bp, Homo sapiens
  misc_feature: GYAE6OF01DVZEG.38.38.D05.1.454.CMB.1.raw
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtcgtggtctccgtggacagtcgatcaccatctcctgcacgtggaagctagtacgtgactagttggtagttaataactattcgtcctccgtacgtaaccaaacaaccacccgaggaccaaaccgaccccaaatcatctaatttagacgactcactcacgtccggtccttcggtacgggtttcctacgttcgtccttctcgtggtcctacgtagttcgacaacgccgtccctccgtacgtaccttacgtttcggcggtccctacggacggtcgtacgggaacgggtacggacggttacgttagtttaaactttttcgtaccgttcctttacctatacgttaacgtaccggaggtaccaacgtacgtaacccggtccccttaacccggttttagtaccggtttaccggtttaaccgggaaccggttacgggtaacccgtacggttaccctacccgttaccgtaccgtccgacccgttaacccgaacccgtccccgaacccttgtccgttacccgtcctttccggttccccggtacccccttccctctaccgtaaccgtacgttaccgtacccgtaggtaccggtaggcccggggttacg

SEQ ID NO: 281160 - DNA, 753 bp, Homo sapiens
  misc_feature: GYAE6OF01AIZAV.38.38.D05.1.454.CMB.1.raw
  modified_base (224)..(224): a, c, t, g, unknown or other
  misc_feature (224)..(224): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtcgtgggtctccgtggactagtcgatcaccatctcctgcactggaagcagtggtcgactagttggtggtttataacgtntgtctacctgtaccaacacacccaggccaaacgccccaactcatcattatcgacgtcactcactccggtcccgtccgtacggggtttcctaccgtccgtccttcgttccgtggtccttaccgtaaggttttcggaccaacgtaccggtccctcctacggtaactcgttttccgacgggtcctaccgacggtctaggaacgggtacgacggtcttagtaactttttagtccgtccttacccgtactacgtaacttaccggagtaccgacgacacgtaccctaacccgttacgttcgttaccttacggggtaaccgttacggggaacccgtaacgggtccctaacccggtttacccgttacccgtaccggttacccgaccccgttaaccgggacccccaaaccccggttacgtccgtttacccggtaaccgtttccccgtcccggtttacccccgaccccgttacctaccggtaaccgggtacgttacccggttaccgaccgggttacgtccgggggtccggttacccggg

SEQ ID NO: 281161 - DNA, 736 bp, Homo sapiens
  misc_feature: GYAE6OF01CCTCM.38.38.D05.1.454.CMB.1.raw
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtcgtgggtctcctggacagtcgatcaccatctcctgcactaggaaccagcagtgacggttggtaggttataactatgtctacgtcgaccaacaaccaccgagaccaaacgccccaactcatagtattatgagtcaactaacgtcgccctcgtagggttctaacgtctccttactctggcctacgaactcgtgacaaccgacggtccctaccctcggacctatccgtcgtgggtccctccgaggtcgtacggagggaaccggtggccttaggtaactttaactttgacgtacgtcgtcctactttagtaaaggtaaagtaaggtactacgtccgttggttacgggttcgggttaccgggccggggaaccgggacccgtaacgggtccgtaccggttaacccggttacccgtaacgtccgtaaacccgggtaccgtaacccgggtcccgtacccggttcccccccgttggttaccccctacccggtttccggtaccccccgtttaccccccggttaccccttccccggtacccgttacggtacgtacccgttaccgggtacggttaccggtcccggggtcgggtaccccgggg

SEQ ID NO: 281162 - DNA, 969 bp, Homo sapiens
  misc_feature: GYAE6OF01A0J39.38.38.D05.1.454.CMB.1.raw
  modified_base (174)..(174): a, c, t, g, unknown or other
  misc_feature (174)..(174): n is a, c, g, or t
tcagtcgatcacgtcacgaccggtgctcgatttagtatctgatagttgggttggggctttgcctgggctctgctgctcctcaccctctcacgtcaggcacgagggtcctgggcccagtctgccctgactcgagcctgccgtcgtgtcgtggctccgtggacagtcatcgacctntctccgtgctacgtggactcgagtgtgactgttggtagttaactaacgttgtcgttaccgtaccgtaggtaaaccccaaacgtacccgtacccggtaaggaccctaaaaaccggtcccccctaaacgtaccgtaccgttaccgttacgtttacgtacggtaaccgttaccgtaaccgttaccgtaccggttcccggtacccgttacggttacggggttttacccttaccgttccggttccgtttaccgttccggttaccggttacccgttaccggttaacgggtttaccgggtaaccgtaacccggtacccggttcccgttacccgttaccggtaacccgtttcggttttaccgggtaccggtacccgttacccgggtaacgggttaccgtacggggtaacggtaccgggtaacggttaccgtttaaacgtttaacgttttacgttacccggtaccgttacccgttaacgtaaccgttaaccgtaacggtaccggtaaccgtaaccggtaccgttaaccgtacccgtttacccggttacggttaccggttaacccgttaaccggtaaccggttaccggtaacccggttaacccgggttaccgttaacccggttacccgtaaccgttacccggtaacccgttaacccggtaacccggtaaccccgtaaccgttacccggttaccgtacccgttaccgttcccgtttaccccggtaccccgttacccttacccggttaccgtaccggttaccgttaacccggtcccggtaaccgtcccgggtccgggtccggtccgg

SEQ ID NO: 281163 - DNA, 664 bp, Homo sapiens
  misc_feature: GYAE6OF01DDQ0M.38.38.D05.1.454.CMB.1.raw
  modified_base (223)..(223): a, c, t, g, unknown or other
  misc_feature (223)..(223): n is a, c, g, or t
  modified_base (620)..(620): a, c, t, g, unknown or other
  misc_feature (620)..(620): n is a, c, g, or t
  modified_base (641)..(641): a, c, t, g, unknown or other
  misc_feature (641)..(641): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtcctgccctgactcacgcctgcctccgtgtcgtgggtctcctggacagtcgatcacatctctgcacgtaggagcagtagtgactagttggtagttaataacttntcgtcctccgtaggtaacccaaacaaccgaccgaaggaccaaaacccgtacccccaaactcacttacgtaattttactacggtacctacctaactccagtcccggcccctacgttacggggtttcctacgtccgtcttctcgtcgcctctagtttcgacaccgaccgtcctcctctacctagttcgtcggtcctcgagtcgtcgaggacgagtcgttagttatttacgtcgtacttccagtattagacgagctacgactacgtaccctacgttagttcgtacgtacgtacgtacggacgtacgtacctccgttaccgacgtcgaccaacccgaccggtacccctaacgtcccttagacccgtacgttccccttacccgtccccctacccgttacccnccgtactccgtacttacccgngtccgggacggtcggtaacccgg

SEQ ID NO: 281164 - DNA, 713 bp, Homo sapiens
  misc_feature: GYAE6OF01CPIU3.38.38.D05.1.454.CMB.1.raw
  modified_base (173)..(173): a, c, t, g, unknown or other
  misc_feature (173)..(173): n is a, c, g, or t
  modified_base (217)..(217): a, c, t, g, unknown or other
  misc_feature (217)..(217): n is a, c, g, or t
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtctgggtctcctggacagtcgatcaccntctctgcactggaagcagtgtgactagttggtgttaactaactntcgtctcgtcgtaaccaacaccaccgagcaaaccgccccaaactcatctatttactgacgtcactcacgtccggcctcggtagggttcctacgtcgtcttctcgtcgctacgtagtttcgacacgacggcctcctacgtaccgtactttccggtggtcctaccgtaggtcgtacggagggacggacggtcttacggtttaaacttttcgttcgttacccttcccgtactaacgtttaactaaccggtaggtaccgacgtaccgaaccggtacccctacccgttttagtccggtttaccgttaccggtaacgttaccggggtaacccgttaacgttacccccgtaccggttacccttaaccgccgaaacccgtccccgaaccggacccctaaacccgtcgtccgttacccgaccgttccgttcccgtcccccggtaccttcccgtaccgttaccgtacgtaccggtacccgtagtaccggaccggggttcggacggg

SEQ ID NO: 281165 - DNA, 750 bp, Homo sapiens
  misc_feature: GYAE6OF01CUVQT.38.38.D05.1.454.CMB.1.raw
  modified_base (177)..(177): a, c, t, g, unknown or other
  misc_feature (177)..(177): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtcctgccctgactcagcctgccctccgtgtctgggtctcctggactgtcgatccaccntcctcctgccagtggaagcgtaagtacgtnactaggttggtaggttaataactnttgtcctccgtagtaaccaacaccaccgagactaaaccgcccaactcatactattatgactcactcatccgccgtacggtacgggttcctacgtcctcttctaccgtcggtcctaccgttagtttcggactaaccgtcccggaccctcccgtacgtaccttaacgtttccgggttacggtcccgttaccgacggtaccggtacggtaacggggacggtacggtacgtttaagttaaacgttttttacgtacgtcccttaccgtactaacgttacacgtacggacgtacgacgaccctacctacccgttagttacgttacgttaccggtacggtacggtaaccgtacgtaccgttaccccttaccgtaccgtaccgaccgtacccaacccgggtacccaaacccggtaccgttacctacccctccgttaacccttccccgggtcccccttacccccgttacccgcccgttaacgtacggttaacccgtcggttaacggaccgtccgggtacggtcccggg

SEQ ID NO: 281166 - DNA, 751 bp, Homo sapiens
  misc_feature: GYAE6OF01AHIL8.38.38.D05.1.454.CMB.1.raw
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
tcagtcgatcacgtcacgaccggtgctcgatttagtatctgatagttgggtttgggggctttgcctgggctctgctgctcctcaccctcctcactcgagggcacagggtcctgggcccagtctgccctgactcagcctgcctcgtgtcgtgggtctccgtaggacagtcgatcaccatctcctgcacgtggaanctagtgnactagttggtagttaataactcgtcgtcctacgtacggtaacccaacaaccgacccgtaggaccaaaacccgaccccctaaatctattacgttaattttacgtacgtaccgtactaccgtaccgtaccggttacccgggtccccttacgggttaccgggtttacctaccgtccgtcttcgtcgtcgtcctacgtagttcgactaccgcgtccctacgtcgtacttcgttccgacgtcctacgacggcgtacggacggacgtacgtacgttacgttaattttcgtccgtccgtttactacttaagtaccgtacggaacggtctaacgacctaccgtacccgttccctttaaggtccgttaacggtaccggtaacggtccgtaaccgtaccgtccgtaccgtaccgtaccgtaccgaacccgaccgtaacccgaaccccgttacccgtcgtacgttccccgtaccgttccccgttccccgtaccccgttccccttaccgtacccgtggtaccctaacggtaccggaaccgttcggggtacgcccggggtacg

SEQ ID NO: 281167 - DNA, 341 bp, Homo sapiens
  misc_feature: GYAE6OF01DD5TZ.38.38.D05.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (323)..(341): a, c, t, g, unknown or other
  misc_feature (323)..(341): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttatgctcctnatatacnggcagcagcctacccttatcgtcttcggaactgggaccaaggtccaccgtcctacgcacgacccaacggccccaaaccccattcgtaccacttccttccgttcccccaccctccgtacacgtgactcgactggacggcgggcctggacgaacggcgacaatgnnnnnnnnnnnnnnnnnnn

SEQ ID NO: 281168 - DNA, 757 bp, Homo sapiens
  misc_feature: GYAE6OF01AQOXG.38.38.D05.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactagttgggtaggttaataacttagtgtccttcctaggtaaccaaactaaccacccagggaccaaaaccgtcccccaaactcattactatttatcgacctcactctacgtccggccccttgtacggggtttcctactccgtctttacgtcgtcggtcttacccgtaaggtttccggactaaaccgtccgggtcccttaccctacggtacccttaacgtttccgtcggggtcctccgacggtccgtaggacggtaccggaggtcttaggttaacttttacgtacgtccttacgtactagtaacgtacgaggacacggtaccaacgacccttacccgttagtcgtttaccggtaccggaacgtacggggaacccgtaaggttccccgtaacccgtccggttaaccgtacccgtaaccggtaccccgaaccggtaccccctaaaccccgtgtacccgttaccgtaacccgttccgttaccccgtacccctaccccttcctaccccggtacgttaccggaccttcccggtaaccgttacgggcccgggttcggtaacccggg

SEQ ID NO: 281169 - DNA, 607 bp, Homo sapiens
  misc_feature: GYAE6OF01A6ZX8.38.38.D05.1.454.CMB.1.raw
  modified_base (199)..(199): a, c, t, g, unknown or other
  misc_feature (199)..(199): n is a, c, g, or t
  modified_base (360)..(360): a, c, t, g, unknown or other
  misc_feature (360)..(360): n is a, c, g, or t
  modified_base (577)..(577): a, c, t, g, unknown or other
  misc_feature (577)..(577): n is a, c, g, or t
tcagtcgatcacgtcacgaccggtgctcgatttagtatctgatagttgggtttgggggctttgcctgggctctgctgctcctcaccctcctcactcagggcacaggggtcctgggcccagtctgccctgactcagcctgcctcgtgtctgggtctcctggacagtcgatcaccatctcctgcaactggaagcagtagtnacatttggtagttataacttatcgtctcctggtaaccaacaaccacccgaggccaaacgccccaaactcatactattatgactcactcactccggcctcgtagggtttcctctcgtcttctctggtctcctaagtttcgacaacaccgtcctccctgactnttcgcggctccgagtctggacggacgaggtctagtacttttacgtgtcctactactacttataccgaggactaggacacgtacccttacccgttagtcgttcttaccggtaactcggaactacggtaccctaccgtcccgtaccgtaccgtacgtaacccgaacgaccccaacccgtctacgccctacgttcccgtccgttccccgcctacccgtcncgtcgtactccgactcggacgtccgggtcg

SEQ ID NO: 281170 - DNA, 542 bp, Homo sapiens
  misc_feature: GYAE6OF01C2N8H.38.38.D05.1.454.CMB.1.raw
  modified_base (187)..(187): a, c, t, g, unknown or other
  misc_feature (187)..(187): n is a, c, g, or t
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (519)..(542): a, c, t, g, unknown or other
  misc_feature (519)..(542): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaaactcatcatttangacgtcactcatccggccctcgaggggtttcactcgtcttctctggctccaagtttggcaacgacggcctcctgacctatttcgtgggctccaggcctggaggacgaggctagtaattttagtgctcctnatatacaggcagcagcctaccccttatcgtcgtacggaaccgtggaaccaacggtaccnccgttctacgcacgaccccgaacgcccaaccccnttcgacctaccgttcttcccgtaccccctacccttcctacgtaccgttgaaccgttcgactgggtacggccgggctcggaccggtaacgggctacgatacgcngtnacnnnnnnnnnnnnnnnnnnnnnnnn

SEQ ID NO: 281171 - DNA, 789 bp, Homo sapiens
  misc_feature: GYAE6OF01BKLCI.38.38.D05.1.454.CMB.1.raw
  modified_base (201)..(201): a, c, t, g, unknown or other
  misc_feature (201)..(201): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgacactgggaagtcagtagtnactagttggtgttaataactatgtcctcctaggtacccaacaccacccgaggacctaaacgcccccaaactcactactactttatgtacgtaccactacatccggccctcggtagggtttctacctcgtcttccgtctcggctccgtacgtttcggcgaacctaccggcccttccctacgtaccgtacgtttcgtcgggtccctccgacgggtccgtacggaacggggtacggtacggtaccgttaagttaaacgtttttacgttaccggtacctttacccttaccgtacttaacgttaaccggtaacgggaccgaacggacctaccggtaccccgttaaccccgttttaaagttccggtttaccgttaccgggtaacggttaccgggaacccgtaacggtacccgtacccgggtacccgttaccggtacccgtaccgtaccccgaacccggtacccccgtaaacccctaccgtaccgttaccgtacccttcccgtacccgtttccccccgaacccgttccccgttacccgtaaccggtaccgtacggtttaccgacccggttacggtccggtcccgggttacccggg

SEQ ID NO: 281172 - DNA, 350 bp, Homo sapiens
  misc_feature: GYAE6OF01CPL49.38.38.D05.1.454.CMB.1.raw
  modified_base (259)..(259): a, c, t, g, unknown or other
  misc_feature (259)..(259): n is a, c, g, or t
  modified_base (311)..(350): a, c, t, g, unknown or other
  misc_feature (311)..(350): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctctcatatacaggcagcatcaccccttatgtcttcggaactgggaccaaggtcaccgtctacgtcagcccaaggcccaaccccactgtccactctcgttcccaccctccncacgtgactcgactgacggcgggtctggacgaagggccgcaagttacgatcnnnnnnnnnnnnnnnnnnnnnnnnnnnnnnnnnnnnnnnn

SEQ ID NO: 281173 - DNA, 686 bp, Homo sapiens
  misc_feature: GYAE6OF01CMVGN.38.38.D05.1.454.CMB.1.raw
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (464)..(464): a, c, t, g, unknown or other
  misc_feature (464)..(464): n is a, c, g, or t
tcagtcgatcacgtcacgaccggtgctcgatttagtatctgatagttgggtttggggggctttgcctgggctctgctgctcctcaccctcctcactcagggcacagggtcctgggcccagtctgccctgactcagcctgcctccggtgtcgtgggtcctccgtggactagtcgatcaccntctcctgcacgtggaagcaaggtagtgactagttggtagttaataactntcggtacctcgtacgtaaccaaccaaccaccgaaggaccaaaaccgtacccccaaactcaagtacctatttaatacgtaacgtccaccgtacctacgttcccggccccttacggttgggggtttaacctaccgtcctcgtttcctcgtcggtcctccgtaagtttcggacctacgaccgtccctcctacgtacttacgtttcgtcgggtcctccgagtcgtggaacggcgaggtntaggttaattttagtcgtacttcctataagtcagagcaacgctacgaccctaccgttatcgacgttacgaacggtgggaaccgtagtccctaaccggtcctacgtacaccgtacccaaccggtccccaaaccctcgtcctacgtcttacccgttcccttaccccgccccttccgacccgtaaggtctaccgtacccggttgaaccggcggtccggtaccggg

SEQ ID NO: 281174 - DNA, 779 bp, Homo sapiens
  misc_feature: GYAE6OF01DWYFK.38.38.D05.1.454.CMB.1.raw
  modified_base (193)..(193): a, c, t, g, unknown or other
  misc_feature (193)..(193): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctccgtggacagtcgatcaccgatcctcctgcacgtggaancagtagtgactagtttcggtagtttaataacttatcgtccttccgtaggtaaacccaaacaaacccacccgaagggaccaaaaaccgcccctaaactcaattcgtaatttactcgacgtacactcagtccgcctacgtacgggtttctacgtcgtcttcgtcgtcggtctaccgttaagtttcgaactaaccgaccggtcccttccgtacggtaaccttacgtttccggtacggtcccttaccggacgggtacgtacggggtaaacgggaccggtaacggtacgtttaaggtttaaacgttttttaacgtcggtaccctttacgtaaacgtttacctaaagtttaacgtaaccggtacgggactaacgggtaccctaacgggtacccctttaccccgttaagttacggtttccggtaaccggtaacggtaccgggtaaaccgtaccggtaccgtacccgtaccgtaccgtacgacccgaacccgtacgaacccctaacccgactcgtaccgtaccgtccgtccgttcccccgtccttaccgaccgtacggttaccacggttacccgacggtccggcggtacccggg

SEQ ID NO: 281175 - DNA, 811 bp, Homo sapiens
  misc_feature: GYAE6OF01B5XHB.38.38.D05.1.454.CMB.1.raw
  modified_base (221)..(221): a, c, t, g, unknown or other
  misc_feature (221)..(221): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtcgtgggtcctcctggacagtcgatcacatctctgcacgtggaagcagcgagtgtacgttggtagttaataaatnttgtcttcgttacggtaaccaactactaccaaccaacactaccgaacccgaaggaaccaaaaccgtacccccaaaactctaatttaaagtttagaggtaacgtacctaaaccgttaaaccggccctacgtaaggttactttactaactccgtactttcgtcgtcggtactaccgtaaggttccgtacggacccaaaccggtcccggtaccccttaccccgtacgaaccccttagtttcccgtaccggttcgggtaccctaacccgtaaaccggtggaaaccgggtaccgtacggtaccttaaccgtatttaacgtttagtcgaccgtaacgtccttaacgtaattaaccacgtaacgtcgtaaccggtccttacggttacgggtttacgggttccgggtacgggaccggggtaaccggaccccgtaccggttaccgggttaaccgttaccgttacgggtaccgaaccggcccgtaaacggtccccgtcccggtacccccggtttcgtaccctcccgtttccccgttcccgtttaccccccgaccccgtttaccctaccggtaccgttcggtaaaccgttcccggaacggg

SEQ ID NO: 281176 - DNA, 799 bp, Homo sapiens
  misc_feature: GYAE6OF01BDZUA.38.38.D05.1.454.CMB.1.raw
  modified_base (131)..(131): a, c, t, g, unknown or other
  misc_feature (131)..(131): n is a, c, g, or t
  modified_base (199)..(199): a, c, t, g, unknown or other
  misc_feature (199)..(199): n is a, c, g, or t
tcagtcgatcacgtcacgaccggtgctcgatttagtatctgatagttgggtttgggggctttgcctgggctctgctgctcctcaccctctcactcaggtcacagggtcctgggcccagtctgccctgactnagcctcgcctcgtgtctgggtctctggacagtcgatcaccatctcctgcacgtaggagctaagtaganacgtagtttgggtagttaataactagttcgttcctaccgttaggaaacccaaaacaacccgaccgaaggaacctaaaaccgacccccctaaaactacctaacttaactaatttaacgtcgtaaccgtctaaccgttccggtacccggtcccggttacgggttaacggggtttacctaaccgttcggttacctttcgttcgtacgggtacctaccgttaaggttcggaccaaaccgtccgtcccttaccgtacgtacctaagtttccggacggtccttaccgaggtccgtaagggaacggtaacgtacggtcgttaagtttaacgttttagtcgttacctacctacttaaatacgtaacgacggaactacgactaacgtaccccttaaccgttgtacgttacccgtaacgggtaacctacgggtaaaccctacgggtaccaacccgggttaccttaaccggtccgaacccgtaacccgtaaccggtaaccccaacccgttataccggtaaccctaggttaccccttaccccggtcccctaccgttaccctacgtaccgtagaaccgttcggaaccgtaggtacgggccggttacggaacgg

SEQ ID NO: 281177 - DNA, 753 bp, Homo sapiens
  misc_feature: GYAE6OF01B12FO.38.38.D05.1.454.CMB.1.raw
tcagtcgatcacgtcacgaccggtgctcgatttagtatctgatagttggggtttcgggggcgtttcgcctgggctctgctgctcctccacccctcctctactcgagggccacgagggtccgtgggcccagtctcgccctgactcaggcctcgccctccgtagtcgtggggtccttcctggacagtccgatcgaccatctacctgtccacggtcggaacgcccaagtcgtgactagtttgggtagttaataactagtcgtcctccgtacgggtaacccaacgaaccaccctaggacctaaacggcccccaaactacacttacgtacttacgtcgtaccgtcctacctcgactccggccctacgtacggggtttcctacgtccgtcttcgtacgtcggtctacgtagtttcggactaacgtaccgtcctcccgtacgtacctacttcgtcggtacctacgacggtcgtaggacggtacggtaggtcgttagttaacttttacgtcgtccgttccgtactaacgtactaaccgacggtaccgtacgaccgtaaccgtacccgtaccccgtttaacgtccgttaccgttaccggtaaccgttacggtacccgtaaccgtccctacccgttacctaaccgtaccgtaccgtaccgtaaccggacccgtaccccgacgttcgtaccgtaccgtaccgttcccgtaccccacccgttcctaccgtacgtacgtacttacggactcggtcggccggtaccg

SEQ ID NO: 281178 - DNA, 768 bp, Homo sapiens
  misc_feature: GYAE6OF01BESZA.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgactagttggttaggttaataacttagtgttcctccgtaggtaacccaaaccaaccacccaaggaccaaaaccgccccaaactcatctatttatgacgtacactacacgtccggtccctcgtacggggtttctaccgttcgtcctttcctcgtcggtcctaccgtaaggtttcgaccaaccgaccggtccctaccctacgtacccttatttcggtcgggtcctccgacggtcgtagggacggacggtacggtacttaggtttaacttttacgtacgtccttacttactaattaacgtacgtacgtaccgaacgtaccgtaaccgtacccctacccgttttagttccgtttaccggttaccgggtaacgtaccgggtaacccgtaacggtcccgttaacccgttccgtacccgtaccgtaacccggacccgtaaccggaccccctaacccgtacgttacccgtctacccgttcccgttccccgttaccccccgttaccccttccggttacccgtaccggtaccgttaccgttacccggaccggttacgggaaccgggtcgggttacccggg

SEQ ID NO: 281179 - DNA, 753 bp, Homo sapiens
  misc_feature: GYAE6OF01AVJWE.38.38.D05.1.454.CMB.1.raw
  modified_base (741)..(741): a, c, t, g, unknown or other
  misc_feature (741)..(741): n is a, c, g, or t
tcagtcgatcacgtcacgaccggtgctcgatttagtatctgatagttgggtttgggggctttgcctgggctctgctgctcctcaccctcctcactcgagggcacgagggtcctcgggcccagtctcgccctgactcagcctgcctccgtgtcgtgggtctccgtggactagtcgatccacctatcctcctgctacgtagggacgcgtaggttagtcgtactagtttgggtagtttaataacttattcgttccttaccgtacggtaacccaaaacctaaacccgaccgacgggaaccaaaacccgaccccctaaaactactacttactattttacgtacgtaacctcctaaccgtctacgtcccggtccccttggttaccgggtttctacctcgtcttcgtcgtcgcctactagtcgacaccgtccgcctacctctccttcgttcgcggtccctcgacggtcgtacggaacggtcgtagtacgttatttagtttacgtcgtccttctactaagttacgtacgaccggactacggacctaccgtacccttaacccgtttagttccgttacggtaacggtacggtaccgggaaccgttaccgtcgtacccgttactcccgtaccgaccgtacccgaccgtaacccctaccgtaccgtacctaccgttccgttcccgttaccccgtcccctaccccgtttcccgacgggtacccgttaccgtaccggtacccggagtacccgggnggtcccggacgg

SEQ ID NO: 281180 - DNA, 890 bp, Homo sapiens
  misc_feature: GYAE6OF01C2VMS.38.38.D05.1.454.CMB.1.raw
  modified_base (110)..(110): a, c, t, g, unknown or other
  misc_feature (110)..(110): n is a, c, g, or t
  modified_base (262)..(262): a, c, t, g, unknown or other
  misc_feature (262)..(262): n is a, c, g, or t
tcagtcgatcacgtcacgaccggtgctcgatttagtatctgatagttggggtttgggggctttgccgtgggctctgctgctccgtcaccctctcgacctcgagggcacgngggtccgtcgggccctagtctgccctggactcgagcctcgcctcgtgtacgtggtctcgtggactaggtaccatccacctatcctccgtgacgtacgtaggaacgtccgtaaggtagcgaacgttgtttacgggtaagttaactaaaccgtnttcggtacccgttaccgtaaggaaacccctaaaccaaccgacccgaaaggtacctaaaacccggtaaccctaactacaacttacctaagtttacgacggtaccggttccaactccgtaccgtccggtccccttagggttaacggtttcctacgtccgttacttccgtacgtccgttacctacggttaaccggtttacggaaccgtaacccgtccgggtcccttaccgtacggttaccttacgggtttacggccgggttaactccggtaacggtacgtaccggtaggggaccgttaaaggtcctttaaacgggttttaacttacggtttcctaaccgttacctacgttaacgttaacgaacggtacgtacgtaaccgtaccgtaccgttaccttaccggttacgttaccgtacggttaaccggtaacggtaccggttaactaccggttaacccgttaccggtaacccggtaccgtaacccgtaccgtaaacccggtaaccgtaaccccgtaaccgttccgtaacgtacccggtaccgttcccgggttacccccttaccgtaccccctttcgtaacccgttcggtaaactaccggtaccgttaccggtcgggaccggttcggaacccggg

SEQ ID NO: 281181 - DNA, 731 bp, Homo sapiens
  misc_feature: GYAE6OF01BJKJ9.38.38.D05.1.454.CMB.1.raw
tcagtcgatcacgtcacgaccggtgctcgatttagtatctgatagttgggtttgggggctttgcctgggctctgctgctcctcaccctcctcactcaggcacagggtcctgggcccagtctgccctgactcagcctgcctccgtgtcgtgggtctcctggacagtcgatcaccactctcctgcacgtggaagcgagtagtagactagttggtgttaataactatcgtcttccgtggtaaccaacaaccgacccaggaccaaaaccgcccccaaactacactactattacgtacgtaccgtacacgtcacgtcccggtcccttacgtacgggtttcctccgtcgtccttctcgtcgtcctaccgtagttcggaccaaccgaccggtcccttacccgcgttaaccgttcgtttcgtcgggtacctccggaacggtcgtaggacggaccggtaggtaccgttagtttaattttacgtcgtccttctactattaacgtagaacgcgtaactacgaccgttacccgttacccttacggttccgttccggttaaccgggtaccgtacgggtaaccgtaacggttccctacccggttacccgacgttacccgaaccgtacccgaccccgtaacccctacccgtacgtccgtacctaccgttcccggttcccgtacccccttcccgttacccgtccgttaccgtacggtaccttacgggatcccgggtgggccggtacg

SEQ ID NO: 281182 - DNA, 740 bp, Homo sapiens
  misc_feature: GYAE6OF01EE2Y2.38.38.D05.1.454.CMB.1.raw
  modified_base (277)..(277): a, c, t, g, unknown or other
  misc_feature (277)..(277): n is a, c, g, or t
  modified_base (718)..(718): a, c, t, g, unknown or other
  misc_feature (718)..(718): n is a, c, g, or t
tcagtcgatcacgtcacgaccggtgctcgatttagtatctgatagttgggttgggggctttgcctgggctctgctgctcctcaccctcctcactcgagggcacagggtcctgggcccagtctcgccctgactcagcctgcctccgtgtctgggtctctggacagtcgatcacctatctcctgcactggaagcagtagtgactagttgggtagttaataactatgtcctccgtagtaaccaacaaccaccaggaccaaacgccccaatcatctattancgactcactcacgtccggcccttcggttacgggtttcctacgttcgtcttcgtcgtcggtacctacgtaagtttcggacaaccgtaccgtccctccctcgtacctacgtttcggtcgggtcctaccggtacggtcgtacgggacggtacggacggttacgtagtttaaactttcgttcgtccttacctactaatacgtaacggtacgactacgactaccgtacccttaacccgttagttaccggtttaccgttaccgggtaacgtacccgggtaacggttaacgtaccccgggttaaccctacccggttaacgacccgaaccgtaaccccggaacccgtaccccgtaacccgtcgttaccgttaccgtacccttacccgtttaccccgtacccctaccccgttccgtacccgtaacgttaccgtaaccgttacgggtaccnccgggtacgggccggtaccggg

SEQ ID NO: 281183 - DNA, 770 bp, Homo sapiens
  misc_feature: GYAE6OF01ESB9V.38.38.D05.1.454.CMB.1.raw
  modified_base (102)..(102): a, c, t, g, unknown or other
  misc_feature (102)..(102): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (419)..(419): a, c, t, g, unknown or other
  misc_feature (419)..(419): n is a, c, g, or t
  modified_base (545)..(545): a, c, t, g, unknown or other
  misc_feature (545)..(545): n is a, c, g, or t
tcagtcgatcacgtcacgaccggtgctcgatttagtatctgatagttgggtttgggggagagaggagccttagccctggattccaaggcctatccacttggngatcagcactgaccaccgaggattcacatggaactggggctccgttgggttttccttgttgtctatttagaaggtgtccagtgtgaggtncagctggngagtcgtggggngctggtcaaggccgtgggggtccctgacgacttctccgtgtcgtaacgtcgtacgttcgacttttccgttccttcctaggtacttactagctaagtcgaacgttggggtcccgccccgtaacgaacggttccccgagggggaaaggggtcggtaacggtacggggttcgggactttacggttacaacttcgtaaacggtttaacccngtaacgttttacggtacggtttacgttaaacgttactaaccttaaacggtaaccctacggtaacgtaaaccggggttccgtaaaggggttcccggaaaccggttacgtttaaccccgtaacccggnttaaccggttaacccgttaaccggaacccgtaaaccggtaacccggtaaaccgtaacggtaacgtaccgtaccgtacgtacgtacgtacgtaacgtacgtacgtacgacgtacgtacggtacgtacgtacgtacgtacgtacgtacgtacgtcgtacgtacgtacgtacgtccgtaacgtacggtaacgtacgttagtacgtacgtagtagtacgtagtccgtcg

SEQ ID NO: 281184 - DNA, 767 bp, Homo sapiens
  misc_feature: GYAE6OF01DXUES.38.38.D05.1.454.CMB.1.raw
  modified_base (192)..(192): a, c, t, g, unknown or other
  misc_feature (192)..(192): n is a, c, g, or t
  modified_base (481)..(481): a, c, t, g, unknown or other
  misc_feature (481)..(481): n is a, c, g, or t
tcagtcgatcacgtcacgaccggtgctcgatttagtatctgatagttgggtttgggggctttgcctgggctctgctgctcctcaccctcctcactcaggcacagggtcctggcccagtctgccctgactcagcctcgcctccgtgtctgggtcctcctggacagtcgatcaccatcctcctgcacgtggaancgtagtagtgactagtttgggtgttaactaacttagttgtccttccgtaggtaaacccaaaccgaaccaccccgaaggaccaaaaccgtacccccaaaactccatactaacttttagtcgtaccgtactacctcgtacgtcccggtaccccttcggttaacggggttttcctaccgttccgttccgtttccttccgtcggccttacctaaggtttcggacctacgaccggtccctccgtaccgtaccttactttccgtcgggacttccgaggtcgtggaacgggaccgnggtacgtttagttaatttttacgtcgtccttccgtactaattaacgtaccaggctaacgaccgaccgtaccccttacccgtttaactcgtttaccgttaaccggaacggttaccgggaaccgttaacggtccctaccggttcccaaccgttcgaaaccccgtacccgtaaccgccccaaacccgtaccggtcctacccgttacgtacccgtttacccgttccccctccccgttccgacccgttacggacggtactaccggagttccgggacgggtcgggtacccgg

SEQ ID NO: 281185 - DNA, 715 bp, Homo sapiens
  misc_feature: GYAE6OF01DSU9M.38.38.D05.1.454.CMB.1.raw
  modified_base (141)..(141): a, c, t, g, unknown or other
  misc_feature (141)..(141): n is a, c, g, or t
  modified_base (166)..(166): a, c, t, g, unknown or other
  misc_feature (166)..(166): n is a, c, g, or t
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (482)..(482): a, c, t, g, unknown or other
  misc_feature (482)..(482): n is a, c, g, or t
tcagtcgatcacgtcacgaccggtgctcgatttagtatctgatagttgggtttgggggctttgcctgggctctgctgctcctcaccctcctcactcgagggcacgagggtcctgggcccagtcctgccctgactcagcctncctcgtgtcgtggtctccgtggacngtcatccacactcgtctanctacgtaggancgagtcgtacatgttaggtataactactgttcgtcctacgtacgtaaccaacgaccaccgacgaaccaacccgacccaactctactacgttattacgtcgacgtaccacactaccgtccgtccgtacggttacggtttcctctccgttactttcgtacgtcgtcttaaccggtacgtttacggacctacgtacccgtcctccgtacgtacttacgttcggtccgtcgacgtacgtcgaacggacgtacggtacgtcgttaatttacgtttcgtccgttactctaanaactacgtacgacgtacgacgtacgacccgttccttaacgttcgttacgtaccgttacggtaacgtaccggtaccgtacgtacccgtaccgtaccgtacccgtagacccggaaccctaccgacccctacgtaccgtacgtccttaaccccggttcctacccggtcccctaccccttcggtaacccgtacgtacctacgttacggtaccggacggtaccggtcgggtaacccgg

SEQ ID NO: 281186 - DNA, 869 bp, Homo sapiens
  misc_feature: GYAE6OF01BMOQ9.38.38.D05.1.454.CMB.1.raw
  modified_base (827)..(827): a, c, t, g, unknown or other
  misc_feature (827)..(827): n is a, c, g, or t
  modified_base (833)..(833): a, c, t, g, unknown or other
  misc_feature (833)..(833): n is a, c, g, or t
  modified_base (837)..(837): a, c, t, g, unknown or other
  misc_feature (837)..(837): n is a, c, g, or t
  modified_base (841)..(841): a, c, t, g, unknown or other
  misc_feature (841)..(841): n is a, c, g, or t
  modified_base (843)..(844): a, c, t, g, unknown or other
  misc_feature (843)..(844): n is a, c, g, or t
  modified_base (848)..(849): a, c, t, g, unknown or other
  misc_feature (848)..(849): n is a, c, g, or t
  modified_base (856)..(856): a, c, t, g, unknown or other
  misc_feature (856)..(856): n is a, c, g, or t
  modified_base (863)..(863): a, c, t, g, unknown or other
  misc_feature (863)..(863): n is a, c, g, or t
  modified_base (865)..(865): a, c, t, g, unknown or other
  misc_feature (865)..(865): n is a, c, g, or t
  modified_base (867)..(868): a, c, t, g, unknown or other
  misc_feature (867)..(868): n is a, c, g, or t
tcagtcgatcacgtcacgaccggtgctcgatttagtatctgatagttgggtttgggggctttgtctgggtctcctggacagtcgatcaccatctcctgcactggaaagctagtagtagacagttgggtaggtttaataaactattagttcctaccgtacggtaaccaaacaaccgacccgaacggacctaaaaccgaccccctaaacttcattactaatttttaagtcggtaactacctacctacgacgttcccgggtacccgttcgggtaaggggttttcctaccgttccggttcctttcgttccggtcggtacccttaccggtttaaaggttccggaacccgtaaaccggcccggtccccctttaccgtaccgtaccgttacgttttccgggtcgggttacccctaccggtacgggtaccttaccggggaacgggggtaaccggacggttaccgttttaacggttttaagtttttaccggttcgtaccctttccctagttaacgtaactacgggaacggcggacctacgacccgaccctttttaaccgttcgttaccgggttccggttaaaccgggaccgggaacggtaaccgggttaccgtaccccgttacccgggttacctcccggtaaccgacccggtaaccccgaacccgttaaccccgaacccggttctaccggttaccctaccctttccggtaccccccgtcccctaccccggttactaccgttcccgggtaacttacccggaccgggtttcccgcggggaacgggtcccggtaccggtcgggaaaccggtcggaaccgttcgcgtaagcccgattccngtacgntcgntcantnncgcnntctcgtncgcgacngntnng

SEQ ID NO: 281187 - DNA, 891 bp, Homo sapiens
  misc_feature: GYAE6OF01AVJ6F.38.38.D05.1.454.CMB.1.raw
  modified_base (856)..(856): a, c, t, g, unknown or other
  misc_feature (856)..(856): n is a, c, g, or t
tcagtcgatcacgtcacgaccggtgctcgatttagtatctgatagttgggtttgggggctttgcctgggctctgctgctcctcaccctcctcactcgagggcacgagggtcctgggcccagttctcgcccctgacctcgacgcctcgccctccgtgtcgtcggtcctccgtggacacgtacgactccacctattccgtcctgaccgtacgtagggaacgcgtaaggttacgtacgtacgttaggttttacgggttaaggtttaacttaaagttccgttccggttacccgtttacccgtaaccggtaaacccaaaaaccgtaaccccgacccggaaacgggaaacccaaaaacccccggtaaccccctaaaacctacctaacttaccgttaatttaacggtacctaaccgtacctaccttaccgccgttaccccggtacccgtttcggggtttaccgggttttacctacccgttccgtttaccgttccgttaccgttacggtaccctttaccgttacgggtttaccggaaccctaacccggtaccccgtcccctaccgttaccgttaccgttaaccggttcggacccgggttctacccggtagggtacgtacggaacgggtacggcggtttaacgttaacgttttaattttaccgctttaccgtctaacgttactacggtacgacggtacgactacgtaacccgtacctttaccgttcgttacgtccggttaacggccggtaaccgaaccgggtacctaccggtaccgttccgaccgacggaacccaccggtaaccctaccctaggttcccacgttaccgtaccttccgttacccctcccacgtttcccacgggttntaccgtaccgtacgacggtcggccggttcgacggg

SEQ ID NO: 281188 - DNA, 665 bp, Homo sapiens
  misc_feature: GYAE6OF01DD4TA.38.38.D05.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (414)..(414): a, c, t, g, unknown or other
  misc_feature (414)..(414): n is a, c, g, or t
  modified_base (619)..(619): a, c, t, g, unknown or other
  misc_feature (619)..(619): n is a, c, g, or t
  modified_base (651)..(651): a, c, t, g, unknown or other
  misc_feature (651)..(651): n is a, c, g, or t
tcagtcgatcacgtcacgaccggtgctcgatttagtatctgatagttgggtttgggggctttgcctgggctctgctgctcctcaccctcctcactcagggcacgagggtcctgggcccagtctgccctgactcagcctgcctcgtgtctgggtcctccgtggacagtcgatcaccntctccngcatggaagcagtatcgatgttgggtattaactaacttgtcgttactccgttacgaaaccaaacaaccacccgaggaaccaaaaccgcccctaaancctatctaagtttntacgactctaacgtcacgtccggtaccgttcgtagggttttacctctcgtcctttcgtacgtcggtacctaccgttaagttcggaccaaccgcggtccctcgcgtaactgtttcggcggccncgacgtcggagaacgggtcgtacggtattagtttaaacttttgtctactccctaattaagacgtaacgacgacacggtacacgtcccttaaccgtttgttcccggtacgttaacggaacggttggaaacccgtacgtccgtaccctacgtaccgaccgtaaccgaccgaaccgtacccaaccctgtcctccacttcccggttccncccccgtctccgtacgtacgataccgtcgacngggaccgtcggcgg

SEQ ID NO: 281189 - DNA, 879 bp, Homo sapiens
  misc_feature: GYAE6OF01AO006.38.38.D05.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtatctgatagttgggtttgggggctttgcctgggctctgctgctcctcaccctcctcactcgagggcacagggtcctgggcccagtctgccctgactcagcctgcctccgtgtctgggtctcctggacagtcgatcaccatctctgcactggaacgcagtacgtgacagttggtgttataactntgtcctctaggtaccaacacacccaggcaaacgccccaaactccatctatttatcgacgtcactcaactccggaccccttcgtacgggggtttccttacgtccgtacttcgttcgtcggtcttaccctaaggttttcggacctaaccgaccggtacccttacccttcgaacccgttacgtttaccgtacggggttcctacccggtacggtacgtacggaacgggggaaacccggtacgggtaccgttaacgggtttaaatttttaacggtttaccggtaccttacccgtaaccgttaacgttaaccgtaaccgttaaaccgggtacgaacgggtcctaaacccgggtaccccttaaacccccgttttaaaggttccccggtttaagttaacccccggggttaaaccgggttaccggggtaaaccggtaaaccggggtttaacccctaacccgggttaccccgttaaccggtacccgtaaacccgggttaccccgaaccgggtaacccccgaaaccccctaccgttacccgttacccgaaccgtttccccggttcccgtttaccccccgtaccccgtttacccccgtaacccgttacccgggttaccgtaccggttacccggtaaccggttcgggtaccgggtaccggggttaaccccggg

SEQ ID NO: 281190 - DNA, 751 bp, Homo sapiens
  misc_feature: GYAE6OF01AVTBI.38.38.D05.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcacatctcctgcacgtggaancagtagtgactattgggtagttaataactatcgtcctcctaggtaaccaacaaccacccgaggaccaaacgcccccaaactcatacatttatcgacgtcactacactccggccctcggtagggtttcctacgtcgtcttctctcggtcctacctaaggtttcgactaaccgaccgggtcccttacccgtacgtaacccttagtttccggtcgggtacctaccggtacggcgttaacggacggggtaccggtacggtaccgttaagttaacgtttttacgtcgttaccttccttaacgtaattaacgtaacgacgggacgtacgaccgtaaccggacccttaaccccggtttacttcggtttacccgttaaccgggtaaccgttaccggggtaaccgtaacgggtacccttaacccggttcccgttaaaccggtcccgaaaccgggtacccgtaacccgggaccccaaacccccggtacttccgtaccctaccgttccgtacccgttccccgtacccctccgtccgtacgttcgtaccgtcgacgtcggagggtccggacgg

SEQ ID NO: 281191 - DNA, 714 bp, Homo sapiens
  misc_feature: GYAE6OF01AF16N.38.38.D05.1.454.CMB.1.raw
  modified_base (289)..(289): a, c, t, g, unknown or other
  misc_feature (289)..(289): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgactagttggtagttataactatcgtctcctgtaaccaacaaccacccagaccaaacgacccctaaactcatactattatagacgtcactnactcggcctcgtaggtttctactcgtcttctctggctacgagtttggacaaccgaccggtcctccgcgtacctatttccgtcggtccacgcggtcgtcgacgggacgaggtacgtagttaaagttttacgttctaccttcctactaactaactaaccgaaggacgtaacgactaacggtaccccttaacccgttactcggtttacccgttaacgggaaacggtccgggtaaaccgaaccgggttccctaaccccgggttaccctaaccgtaccggtacccgaaacccgaacccggaccccgaaaccccctgttacccgtaccctacccgttaccgttcccccgttaccccccgtacccttcccctaacccgtaaccggttacgtaccgtaccgaaccggtaccgggtaccgggtgggtaacccgg

SEQ ID NO: 281192 - DNA, 638 bp, Homo sapiens
  misc_feature: GYAE6OF01DCTWA.38.38.D05.1.454.CMB.1.raw
  modified_base (92)..(92): a, c, t, g, unknown or other
  misc_feature (92)..(92): n is a, c, g, or t
  modified_base (166)..(166): a, c, t, g, unknown or other
  misc_feature (166)..(166): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
  modified_base (316)..(316): a, c, t, g, unknown or other
  misc_feature (316)..(316): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
  modified_base (444)..(444): a, c, t, g, unknown or other
  misc_feature (444)..(444): n is a, c, g, or t
  modified_base (596)..(596): a, c, t, g, unknown or other
  misc_feature (596)..(596): n is a, c, g, or t
  modified_base (621)..(621): a, c, t, g, unknown or other
  misc_feature (621)..(621): n is a, c, g, or t
tcagtcgatcacgtcacgaccggtgctcgatttagtatctgatagttgggtttgggggctttgcctgggctctgctgctcctcaccctcctnactcgaggcacgagggtcctgggcccagtctcgaccctgactcacgcctcgcctcgtgtcgtggtctctagganagtcgatcaaccntccnctgacngtagagcaagtacgtgactagttggtagttaatacgttatcgtccttacgtacgaaccaaacaaccgaccgacggaaccaaacccgaccccaaagttcaactactaatttagacgtaccgcactacncgtccgtacttcggtacggttactacgtctactctgcgtctagtagtcgaacacgccncctactacgacttgttcggngccacgagcgaggaggactagtactaagtttagttacgtctaccttaganaatacaacggagtacaacactaccggaaccctttacgtagttaccgtacgtaacggacggtaacggaccgtaacgtcccgtaacgtcccgttagacccaaccggaacccaaccggtacctacccattccggactaccctccggtaccctacncccctagtacgtatactcgtaacgnggacggcggaacgtcgg

SEQ ID NO: 281193 - DNA, 763 bp, Homo sapiens
  misc_feature: GYAE6OF01BG3R0.38.38.D05.1.454.CMB.1.raw
tcagtcgatcacgtcacgaccggtgctcgatttagtatctgatagttgggtttgggggctttgcctggactctgctgctcctcaccctcctcactcagggcacagggtcctgggcccagtctgccctgactcagcctgcctccgtgtctgggtctctggacagtcgatcaccatcctcctgcacgtggaagcagtagtagactagtttgggttaggtttaataacttatcgtcctccgtacggtaaccaaaccaaccacccgaggaccaaaccgacccccaaactcaatcgtattagtacgacgtacacctacacgtccgtcccgttcggttacgggtttcctacgtccgtcttccgtcgtggcttaccgtaaggtttcggacaccgacccggtccttcccgtacgtaccttacgtttccggtacgggtccgtccgacgggtccgtagggaacgggtacgtacgggtcttagtttaacgtttttacttccggttccttacttactacttaacgtaacggacggtcgaacgtccgtacccgtacccgtttacccgtttacgttcggttacccggtttaaccgggtaaccggttacgggaacccgtaacgttcccgtaaccccgttaccgtaccgtcccgacccggtaaccccgaacccgtacccctaaacccctggttacctcctaacccgttcccttcccgtaccccctaccccgttctaccgtacgtaccgtacgtacgacgtcgggtcgggccggtaccgg

SEQ ID NO: 281194 - DNA, 298 bp, Homo sapiens
  misc_feature: GYAE6OF02HH3R4.38.38.D05.1.454.CMB.1.raw
  modified_base (293)..(298): a, c, t, g, unknown or other
  misc_feature (293)..(298): n is a, c, g, or t
tcagtcgatcacgtcacgaccggtgctcgatttagtatctgatagttgggtttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcttacgtcagcccaaggccaacccactgtcactctgttcccgccctcctcacgtgatcgactgagcgggctggcaaggcgcatagnnnnnn

SEQ ID NO: 281195 - DNA, 518 bp, Homo sapiens
  misc_feature: GYAE6OF02IPP4Q.38.38.D05.1.454.CMB.1.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctctaggctgagacgaggctgaattttatgctcctcatatacaggcagcagcacccttatgtcttcggaactgggaccaaggtcaccgtcctacgtcacgcccaaggcccaaaccccatcgtcactcctcgttccccgcctcctcacgtgactccgactgacgcggc

SEQ ID NO: 281196 - DNA, 533 bp, Homo sapiens
  misc_feature: GYAE6OF02I2CHU.38.38.D05.1.454.CMB.1.raw
  modified_base (352)..(352): a, c, t, g, unknown or other
  misc_feature (352)..(352): n is a, c, g, or t
tcagtcgatcacgtcacgaccggtgctcgatttagtatctgatagttgggtttgggggtcgtttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcaatcatttatgacgtcactcatcggccctcaggggtttctactcgcttctctggctccaagtttggcaacacggcctcctgacctatttcngggctccgaggctgaggacgaggctagtaattttatgcttcctcatactacaggcagcagcctacccttatcgtcttcggaactggaccaggtcaccgtcctacgcacgccaacggcccaacccgatcgtacactcgtcgttcccgccttcctcacgtcgacttccgactggacgcggtcg

SEQ ID NO: 281197 - DNA, 515 bp, Homo sapiens
  misc_feature: GYAE6OF02IW094.38.38.D05.1.454.CMB.1.raw
  modified_base (193)..(193): a, c, t, g, unknown or other
  misc_feature (193)..(193): n is a, c, g, or t
  modified_base (344)..(344): a, c, t, g, unknown or other
  misc_feature (344)..(344): n is a, c, g, or t
  modified_base (415)..(415): a, c, t, g, unknown or other
  misc_feature (415)..(415): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagtcgatcacgtcacgaccggtgctcgatttagtatctgatagttgggtttggggcgtttgcctgggctctgctggctcctcaccctcctcactcagggcacagggtcctgggccctagtctgccctgactcagcctgcctccgtgtcgtgggtctcctggacagtcgatcaccatctcctgcactggaancaggtagtgacattggtggttaataactatgtctcctggtaccaacaacacccaggcaaagccccaaaactcatcatttatgacgtcactcatcggccctcaggggtttctactcgcttctctggctccaagtttggcaacacggcctccngaccattctgggctccaggctgagcgaggctgattttatgctcctcatatacaggcagcagccacccttantcttcggaactggaccaaggtcaccgtctacgnacgcccaaggccaaacccnctcgtcactcctgttccccgcctcctcactgactcgactgacgcggcg

SEQ ID NO: 281198 - DNA, 517 bp, Homo sapiens
  misc_feature: GYAE6OF02G1C7T.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtcctacgtcacgcccaaggccaacccactgtcactctcgttcccaccctcctcacgtcgactcgactgacgcggc

SEQ ID NO: 281199 - DNA, 453 bp, Homo sapiens
  misc_feature: GYAE6OF02G01M5.38.38.D05.1.454.CMB.1.raw
  modified_base (447)..(453): a, c, t, g, unknown or other
  misc_feature (447)..(453): n is a, c, g, or t
tcagtcgatcacgtcacgaccggtgctcgatttagtatctgatagttgggtttggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccgccctcctcacgtgatcgactgagcgggctggcaagcgcatagnnnnnnn

SEQ ID NO: 281200 - DNA, 512 bp, Homo sapiens
  misc_feature: GYAE6OF02JZ8O1.38.38.D05.1.454.CMB.1.raw
  modified_base (348)..(348): a, c, t, g, unknown or other
  misc_feature (348)..(348): n is a, c, g, or t
  modified_base (465)..(465): a, c, t, g, unknown or other
  misc_feature (465)..(465): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcacggggtttctactcgcttctctggctcaagtttggcaacacggcctcctgacctattcngggctccaggctgaggcaggctgaattttatgctctcatatacagcagcagccacccgttatcgtcttcggaactcgggacctaaggtcaccgtcctacgtcacgccagcccaaccnctcgcactctctcccacctcctcacgtcactcgactggacgcggtcg

SEQ ID NO: 281201 - DNA, 522 bp, Homo sapiens
  misc_feature: GYAE6OF02IL1HZ.38.38.D05.1.454.CMB.1.raw
  modified_base (396)..(396): a, c, t, g, unknown or other
  misc_feature (396)..(396): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaattttatgctctcatataacnggcagcagcacccttatgtcttcggaactgggaccaaggtccaccgtcctacgtcacgcccaaggcccaaacccatcgtcactctcgttccccgcctcctcacgttcgactccgactgcgcggtcg

SEQ ID NO: 281202 - DNA, 571 bp, Homo sapiens
  misc_feature: GYAE6OF02GAPZ7.38.38.D05.1.454.CMB.1.raw
  modified_base (358)..(358): a, c, t, g, unknown or other
  misc_feature (358)..(358): n is a, c, g, or t
tcagtcgatcacgtcacgaccggtgctcgatttagtatctgataggttgggtttggggctttgcctgggctctgctgctcctcaccctcctcacctcagggcacagggtcctgggcccagtctgccctgactcagcctgcctccggtgtctgggtctcctggacagtcgatcaccatctcctgcactggaagcaggtagtgacagttggtggttataactatggtctcctggtaccaacaacacccaggcaaacgccccaaactcatcattatgacgtcactcatcggccctcaggggtttcactccgcgttctcgtggctccgaagtttggcaacacggcctcctgacctagtttcngggctaccaggctgaggacgaggtctaggaatttttagttcgcttcctcagttactacgacggcagcacgccaccccttatcgtccttacggaacttcgggaacctaacggtccaccgttcctacgtccacgcccaacggcccaaacccgactcgtaccactcgtcgttcccgccctccgtcacgtcgacgtccgacttggacggcggtaccg

SEQ ID NO: 281203 - DNA, 304 bp, Homo sapiens; identical to SEQ ID NO: 280953
  misc_feature: GYAE6OF02GCM55.38.38.D05.1.454.CMB.1.raw
  modified_base (295)..(304): a, c, t, g, unknown or other
  misc_feature (295)..(304): n is a, c, g, or t

SEQ ID NO: 281204 - DNA, 297 bp, Homo sapiens; identical to SEQ ID NO: 281041
  misc_feature: GYAE6OF02IGLXP.38.38.D05.1.454.CMB.1.raw
  modified_base (288)..(297): a, c, t, g, unknown or other
  misc_feature (288)..(297): n is a, c, g, or t

SEQ ID NO: 281205 - DNA, 519 bp, Homo sapiens
  misc_feature: GYAE6OF02HMNDM.38.38.D05.1.454.CMB.1.raw
  modified_base (195)..(195): a, c, t, g, unknown or other
  misc_feature (195)..(195): n is a, c, g, or t
  modified_base (270)..(271): a, c, t, g, unknown or other
  misc_feature (270)..(271): n is a, c, g, or t
  modified_base (289)..(289): a, c, t, g, unknown or other
  misc_feature (289)..(289): n is a, c, g, or t
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagtcgatcacgtcacgaccggtgctcgatttagtatctgatagttggggtttagggggctttgcctgggctctgctggctcctcaccctcctcactcagggcacagggtcctcgggcccagtctgccctgactcagcctgcctccgtgtctgggtctcctggacagtcgatccaccatctcctgcactggaancagtagtgacattggtggttataactatgtctcctggtaccaacaacaccagcaaagccccaaatcatcatttannacgtcactcatcggcctnagggtttctactcgacttctctggctcccaagtttggcaacaccggcctccctgacctatttctgggctccaggctgagacgaggctgaattttatgctcctcatatactagcagcagcacccttatgtcttcggaactgggaccaaggtcaccgtctacgtcagccaaggccaacccgntcgtcacgtctacgtcccncctcctcacgtcactccgactgacgcggtcg

SEQ ID NO: 281206 - DNA, 512 bp, Homo sapiens
  misc_feature: GYAE6OF02IGL7V.38.38.D05.1.454.CMB.1.raw
  modified_base (464)..(464): a, c, t, g, unknown or other
  misc_feature (464)..(464): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagttttggcaacacggcctccctgaccatttctgggctccaggctgaggacaggctgaattttattgctctcatatacaggcagcagcacccttatgtcttcggaactgggaccaaggtcaccgtctacgtcagcccaagccaacccnctgtcactctcgttcccacctcctcacgtgactccgactgacgcggcg

SEQ ID NO: 281207 - DNA, 465 bp, Homo sapiens
  misc_feature: GYAE6OF02HIYBO.38.38.D05.1.454.CMB.1.raw
  modified_base (267)..(267): a, c, t, g, unknown or other
  misc_feature (267)..(267): n is a, c, g, or t
  modified_base (448)..(448): a, c, t, g, unknown or other
  misc_feature (448)..(448): n is a, c, g, or t
  modified_base (454)..(465): a, c, t, g, unknown or other
  misc_feature (454)..(465): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttcngggctccaggctgaggacgaggctgaattttatgctcctcatatacaggcagcagcacccttatgtcttcggaactggaccaaggtcaccgtcctacgtcacgcccaaggcccaaccccactcgtcacctctcgttccccgccctcctcacgtgactccgactgagcgggctggcaaggcncatagnnnnnnnnnnnn

SEQ ID NO: 281208 - DNA, 514 bp, Homo sapiens
  misc_feature: GYAE6OF02J1ZNB.38.38.D05.1.454.CMB.1.raw
  modified_base (461)..(462): a, c, t, g, unknown or other
  misc_feature (461)..(462): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccattctgggctccaggctgagacgaggctgaattttatgctctcatatacaggcagcagcacccttatgtcttcggactggaccaaggtcaccgtcctacgtcagcccaaggccaacccnncgtcactcgtcgttccccgctccctcacgtcgactccgactcgacgcggtcg

SEQ ID NO: 281209 - DNA, 801 bp, Homo sapiens
  misc_feature: GYAE6OF02INKS9.38.38.D05.1.454.CMB.1.raw
  modified_base (728)..(728): a, c, t, g, unknown or other
  misc_feature (728)..(728): n is a, c, g, or t
tcagtcgatcacgtcacgaccggtgctcgatttagtatctgatagttgggacgtttagggggacctttgtctcgggttcctcctggacaccgtcgatcaccaatcctccctgcgactgggaacgcgaggtagtcgtacttagttgggtggttataactatcgtctccgtggtacccaacaaccacccgacggacaaacgtcccccaaactcaattccaggtttactgaacggttcaactacactcggggcccctcagggggtttctaacgttcgcttctacgtggtcctaccgaagttttcggacctaaccaccgggtacccgttacccttggaccctaattttcctaggggtcgttcccgacgggcctaggaccggggaccgaaggggtccttggaaatttttagttaggtcggttacccttcgattactaaccgacgggtcgagactaggaccaaccccttaaaattcgtacttacgggaaacttcggggaaccgaacggtcaccggtcctaaccgtttcaacgggtaccccaaacgggtcccaaacccccgacgtacggtacctaacctttccgttacgttccccgaaccccgttccctacgtaacggtcgaacttcccggtaacgtcgggaacgtcccgggggaccttacggggacccgtaaacggggtccggtaccgttaagttttacggggctcgaccgtcgtagtacggcgtacgtagttntaccgcgtactaacgtttgacgttaccgtcggggacgtaacgggtaccgtcgggtaccacgttccgcctaccg

SEQ ID NO: 281210 - DNA, 515 bp, Homo sapiens
  misc_feature: GYAE6OF02F4QON.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagttttggcaacacggcctccctgaccattctgggctccaggctgaggacgaggctgaattttatgctctcatatacaggcagcagcacccttatcgtcttcgaactgggaccaaggtcaccgtcctacgtcacgcccaagccaacccactcgtcactctcgtcccaccctcctcacgtcactccgactgacgcggcg

SEQ ID NO: 281211 - DNA, 636 bp, Homo sapiens
  misc_feature: GYAE6OF02FV722.38.38.D05.1.454.CMB.1.raw
tcagtcgatcacgtcacgaccggtgctcgatttagtatctgatagttggggtttggggggctttgcctcgggacctcgtgctgctcctcgaccctcctcacgtccagggcacagggtcctgggcccgagtcctgccctgactcgagcctgacctccgtcgtctgggtctcctggacacgtcgatcacccatctcctgcacctggaagcagtagtgacagttggtggttataactatcgtctcctggtaccaacaacgacccaggcaaacgccccaaatcaatcaatttatagtacgtcactcatcggaccctgagggttcacctgcttctctgctccaagtttggctaacacggaccttccgtagtacccgtactttcgtcggggaccttaccgtaggcttggaacgggaacggtagggccttggtaaagttttactgtcctttacctacaattaactaacagggccaggccgaacgctaacccctttagtcgttacttccggaacttcgggtaacctaagggttccaaccgtacctacgtcgacgtacccaacggtcccaaaccctcttacgtccgacctcggtactacccacccgtcctacacgtacgacttaccggactcggacgcggtaccg

SEQ ID NO: 281212 - DNA, 517 bp, Homo sapiens
  misc_feature: GYAE6OF02GPG63.38.38.D05.1.454.CMB.1.raw
  modified_base (411)..(411): a, c, t, g, unknown or other
  misc_feature (411)..(411): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttcactcgcttctctggctccaagtttggcaacacggcctccctgaccatttctgggctccaggctgaggacgaggctgaattttattgctctcatatacaggcagcagcacccttangttcttcggaactggaccaaggtcaccgtcctacgtcacgcccaaggccaacccactgtcactctcgttcccgccctcctcacgtgactccgactggacgcggtcg

SEQ ID NO: 281213 - DNA, 609 bp, Homo sapiens
  misc_feature: GYAE6OF02JYEHN.38.38.D05.1.454.CMB.1.raw
  modified_base (239)..(239): a, c, t, g, unknown or other
  misc_feature (239)..(239): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (523)..(523): a, c, t, g, unknown or other
  misc_feature (523)..(523): n is a, c, g, or t
  modified_base (556)..(556): a, c, t, g, unknown or other
  misc_feature (556)..(556): n is a, c, g, or t
tcagtcgatcacgtcacgaccggtgctcgatttagtatctgatagttgggtttgggggtcgtttgtcctgggctctgctgctcctcaccctcctcactcaggcacagggtcctgggcccagtctgccctgactcagcctgcctccgtgtctgggtctcctggacagtcgatcacatctcctgcactggaagcagtagtgacattgggtgttataactatgtctcctggtaccaacaacnccaggccaaaacgccccaaactcatcaattatgacgtcactcatcggccctgagggtttctactcgtcttctctggctaccagtttcgcaacncggcctccgtnacctattcgcggtctaccgagctagacggtacgaggtctagtaacttttntcgctcctanattanaccaggtccaagtcacgtacctacccgttatcgttacttaccggaaactcgggaacccgtaagttcccaaccgttcccgtacgtccaacgtcccgaaacggtccccaaacccgtnttccgtaccaccgtttccctccgggtttccccncccttacgtccgtaaccgtcgttactccggaccttcggaacggtccggggtac

SEQ ID NO: 281214 - DNA, 602 bp, Homo sapiens
  misc_feature: GYAE6OF02JI12V.38.38.D05.1.454.CMB.1.raw
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
tcagtcgatcacgtcacgaccggtgctcgatttagtatctgatagttgggtttgggggcgtttgcctgggctctgctgctcctcaccctcctcactcagggcacagggtcctgggcccagtctgccctgactcagcctgcctccgtgtctgggtctcctggtacagtcgatcacctatctcctgcactggaagcaggtagtgacattggtggttataactatgtctcctggtaccaacaacnccaggcaaagccccaaatcagtcatttatgacgtnactnatccggccctcgaggggtttcaagtcgcttctctgcatccaaagtctaggcaaacgacggcctccctgacccattcctcgtcgggaccttccgaagggcttaggaacggacgaacgggtcttaaactttatttccgtagactattaccgaatataacaaccagacaactactcgtgctaattcggacggtaggaccaagccttcgaacccgtactaacgtcgaacgtcccaaggccttaccgaccccgtcgttcccgaaccttcgttaccgttcccccgaccccttcccgttactaaccgtggtacttaccgtacgtcggg

SEQ ID NO: 281215 - DNA, 546 bp, Homo sapiens
  misc_feature: GYAE6OF02GDB3L.38.38.D05.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (360)..(360): a, c, t, g, unknown or other
  misc_feature (360)..(360): n is a, c, g, or t
  modified_base (425)..(425): a, c, t, g, unknown or other
  misc_feature (425)..(425): n is a, c, g, or t
tcagtcgatcacgtcacgaccggtgctcgatttagtatctgatagttgggtttgggggctttgcctcgggctctgctgctcctcaccctcctcactcgacgggcacagggtcctgggcccgagtctgccctgactcagcctgcctccgtgtctgggtctcctggaccagtcgatcaccatctcctgcactggaancagtagtgacattggtgttanaactatgtctcctggtaccaanaacacccaggcaaacgccccaaaactcattcactttatgacgtcactcaactcggccctcacggggtttcactcgcttctctggctccaagtttggcaacacggcctccctgaccgtattcngggcttcaggctgagcgagctgaattttatgctcctcatatactaggcagcacgcctacccttangtcttcggaactggaccaagtcaccgtctacgtcacgccaaggcccaaacccacttcgtcgacctccgtcgttcccggccctccgtcgaccgttcgaacttccgacttcggacgcggtacg

SEQ ID NO: 281216 - DNA, 529 bp, Homo sapiens
  misc_feature: GYAE6OF02FWCG7.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcctgaccatttctgggctccaggctgaggacgaggctgtaattttatgctcctcatatacaggcagcagccacccttatcgttcttcggaactgggaccaaggtccaccgtcctacgtcacgcccaaggcccaacccactcgtccactcctcgtcccgccctccctcacgtcgactccgactcgacgcggtccg

SEQ ID NO: 281217 - DNA, 460 bp, Homo sapiens
  misc_feature: GYAE6OF02H7HT3.38.38.D05.1.454.CMB.1.raw
  modified_base (307)..(307): a, c, t, g, unknown or other
  misc_feature (307)..(307): n is a, c, g, or t
  modified_base (444)..(444): a, c, t, g, unknown or other
  misc_feature (444)..(444): n is a, c, g, or t
  modified_base (450)..(460): a, c, t, g, unknown or other
  misc_feature (450)..(460): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctnatatacaggcagcagcaccccttatgtcttcggaactgggaccaaggtcaccgtctacgtcagcccaagcccaacccactgtcactctcgttccccgcccttcctcacgtgactcgactgagcgggctggcaaggcncatagnnnnnnnnnnn

SEQ ID NO: 281218 - DNA, 553 bp, Homo sapiens
  misc_feature: GYAE6OF02H19JY.38.38.D05.1.454.CMB.1.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (494)..(494): a, c, t, g, unknown or other
  misc_feature (494)..(494): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctctggtaaccaacaacacccaggaccaaacgccccaaatcatctatttatgacgtcactcactcggcctcgagggtttctactcgtcttctctgctctagttgcaacacgctcctgacctntttcnggctccgaggctaggaggacgaggctagttaatttttagtcgtctccttcaattactacgaggcacgcagcctaaccctttatcgttcttacggaacgtgggaacctaggtccaccgtcctacgtcacgacccaaggcccaaccctntcgtccacttcgtccgttacccaccctcctacgacgtcactacgtcgagccggctacgg

SEQ ID NO: 281219 - DNA, 465 bp, Homo sapiens
  misc_feature: GYAE6OF02GZCHJ.38.38.D05.1.454.CMB.1.raw
  modified_base (447)..(447): a, c, t, g, unknown or other
  misc_feature (447)..(447): n is a, c, g, or t
  modified_base (453)..(465): a, c, t, g, unknown or other
  misc_feature (453)..(465): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtcctacgtcagcccaaggcccaaccccactcgtcactctcgttccccgccctcctcacgtgactcgactgagcgggctggcaaggcncatagnnnnnnnnnnnnn

SEQ ID NO: 281220 - DNA, 536 bp, Homo sapiens
  misc_feature: GYAE6OF02G5M97.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagttggcaacacggcctcctgaccatttctgggctccaggctgaggacgaggctgtaattttatgctcctcatatacaggcagcagcctaccccttatgtcttcggaactgggaccaaggtccaccgtcctacgtcacgcccaacggcccaaaccccactcgtccactccttcgttccccgccctcctcaccgtttcgactcgacctggacggcggtcg

SEQ ID NO: 281221 - DNA, 524 bp, Homo sapiens
  misc_feature: GYAE6OF02HUF51.38.38.D05.1.454.CMB.1.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggctaacacggcctccctgaccatttctgggctccaggctgaggacgaggctgaattttatgctctcatatacaggcagcagcacccttatgtcttcggaactgggaccaaggtcaccgtcctacgtcacgcccaaggccaaccccatcgtcacttcgtcgttcccgccctcctcacgttcgactcgacctgacggcgggtcg

SEQ ID NO: 281222 - DNA, 524 bp, Homo sapiens
  misc_feature: GYAE6OF02GA6TH.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcactttgggtgttcgggcggagggaccgaccgtgaccgtcgttaggtcagcccaaggctgcccctcggtcactctcgttcccgccctcctcaccgtgactccgactcgg

SEQ ID NO: 281223 - DNA, 522 bp, Homo sapiens
  misc_feature: GYAE6OF02JFJ1A.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagctaccccttatgtcttcggaactgggaccaaggtcaccgtcctacgtcagcccaaggcccaacccactcgtcactctcgttcccaccctcctcacgtgactccgactgacgcggtcg

SEQ ID NO: 281224 - DNA, 468 bp, Homo sapiens
  misc_feature: GYAE6OF02JGV1K.38.38.D05.1.454.CMB.1.raw
  modified_base (446)..(446): a, c, t, g, unknown or other
  misc_feature (446)..(446): n is a, c, g, or t
  modified_base (451)..(468): a, c, t, g, unknown or other
  misc_feature (451)..(468): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactggaccaaggtcaccgtcctacgtcagcccaaggccaaccccactcgtcactctcgttccccaccctcctcacgtgatcgactgacgcgggctggcaaggcncatgnnnnnnnnnnnnnnnnnn

SEQ ID NO: 281225 - DNA, 298 bp, Homo sapiens
  misc_feature: GYAE6OF02GYM8O.38.38.D05.1.454.CMB.1.raw
  modified_base (288)..(298): a, c, t, g, unknown or other
  misc_feature (288)..(298): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccaccctcctcacgtgatcgactgagcgggctggcaaggcgcatagnnnnnnnnnnn

SEQ ID NO: 281226 - DNA, 458 bp, Homo sapiens
  misc_feature: GYAE6OF02G4LF7.38.38.D05.1.454.CMB.1.raw
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (446)..(458): a, c, t, g, unknown or other
  misc_feature (446)..(458): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaatttttatgctcctcatatacaggcagcagcaccccttatgtcttcggaactgggaccaaggtcaccgtctacgtcagcccaaggcccaaccccatcgtcactctcgttcccgccctcctcacgtnactcgactgagcggctgcaggcnatgnnnnnnnnnnnnn

SEQ ID NO: 281227 - DNA, 307 bp, Homo sapiens
  misc_feature: GYAE6OF02GEZ0D.38.38.D05.1.454.CMB.1.raw
  modified_base (281)..(281): a, c, t, g, unknown or other
  misc_feature (281)..(281): n is a, c, g, or t
  modified_base (287)..(307): a, c, t, g, unknown or other
  misc_feature (287)..(307): n is a, c, g, or t
tcagtcgatcacgtcacgaccggtgctcgatttagtatctgatagttgggtttctactcggcttctctggctccaagtttggcaacacggcctccctgaccatttctgggctccaggctgaggacgaggctgaattttattgctcctcatatacaggcagcagcaccccttatgtcttcggaactgggaccaaaggtcaccgtcctacgtcagcccaaggccaaccccactgtcactctgttcccacctctcacgtgatcgactgagcggctggcaaggcncatagnnnnnnnnnnnnnnnnnnnnn

SEQ ID NO: 281228 - DNA, 503 bp, Homo sapiens
  misc_feature: GYAE6OF02FW83S.38.38.D05.1.454.CMB.1.raw
  modified_base (268)..(268): a, c, t, g, unknown or other
  misc_feature (268)..(268): n is a, c, g, or t
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
  modified_base (459)..(459): a, c, t, g, unknown or other
  misc_feature (459)..(459): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggccctcaggggtttctactcgcttctctggctccaagtttggcaacacggcctccctgaccatttctgggctccaggctgaggacgaggctgaattttatgctctnatatacaggcagcagcacccttangtcttcgactggaccagtcacgtccagtcagccaagcccaacccacntcactctcgttcccaccctcctcacgtgactccgatgagcgggc

SEQ ID NO: 281229 - DNA, 531 bp, Homo sapiens
  misc_feature: GYAE6OF02HA4CN.38.38.D05.1.454.CMB.1.raw
  modified_base (484)..(484): a, c, t, g, unknown or other
  misc_feature (484)..(484): n is a, c, g, or t
tcagtcgatcacgtcacgaccggtgctcgatttagtatctgatagttgggtttgggggctttgcctgggctctgctgctcctcaccctcctccactcagggcacagggtcctgggcccagtctgccctgactcagcctgcctccgtgtctgggtctcctggacagtcgatcaccatcctcctgctactggaagcgaagtagtgaccatttggtggttataacgtatgtctcctggtaccaacaacacccaggcaaagccccaaactcatcatttatgacgtcactcatcggccctcaggggtttctactcgcttctctggctccaagtttcggcaacacggcctccctgaccatttctgggctccgaggctgagacgaggctgaattttatgctcctcatactacaggcagcagcctaccctttatcgtcttcggaactgggacctaggtcaccgtcctacgtcacgcccaacggcccaacccngtgcactctcgttcccacctcctcacgtcactcgactgacgcggtcg

SEQ ID NO: 281230 - DNA, 517 bp, Homo sapiens
  misc_feature: GYAE6OF02HQJOY.38.38.D05.1.454.CMB.1.raw
  modified_base (345)..(345): a, c, t, g, unknown or other
  misc_feature (345)..(345): n is a, c, g, or t
  modified_base (513)..(513): a, c, t, g, unknown or other
  misc_feature (513)..(513): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaatcatcatttatgacgtcactcatcggccctcagggtttctactcgcttctctggctcaagtttggcaacacggcctcctgaccatttcnggctcaggctgagacgaggctgtaattttatgctcctcatatacagcagtagctaccccttatcgtcttcggaactcgggaccaggtcaccgtcctacgtcacgacccaacgcccaacccactcgtcactctcgtcccaccctcctcacgtgactcgactgacgcggntcgg

SEQ ID NO: 281231 - DNA, 512 bp, Homo sapiens
  misc_feature: GYAE6OF02I2JFR.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctgcatccaagtctggcaacacggcctccctgaccatctctgggctccaggctgaggacgaggctaattactttctgcagttcattataacaaccagcaacactctgctattcggcggagggaccaagctgaccgtctaagtcagcccaaggcctgcccctggtccactctcgttcccgccctcctcacgtcgactcgactcgg

SEQ ID NO: 281232 - DNA, 522 bp, Homo sapiens
  misc_feature: GYAE6OF02F5BK9.38.38.D05.1.454.CMB.1.raw
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggcctcaggggtttctactcgcttctctggctccaagtttggcaacacggcctcctgaccattcngggctccaggctgaggacgaggctgtaattttatgctcctnatatacaggcagcagcacccttatcgtcttcggactgggaccaagtcaccgtcctacgtcacgcccaaggcccaacccactcgtcctactcgttcgttccccgccctcctcacgtcactccgactgacgcggtcg

SEQ ID NO: 281233 - DNA, 534 bp, Homo sapiens
  misc_feature: GYAE6OF02GJIZ1.38.38.D05.1.454.CMB.1.raw
  modified_base (348)..(348): a, c, t, g, unknown or other
  misc_feature (348)..(348): n is a, c, g, or t
  modified_base (470)..(470): a, c, t, g, unknown or other
  misc_feature (470)..(470): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcctgaccatttcngggctccagctgaggacgaggctgaattttatgctcctcatatacaggcagcagccacccttatcgttcttcggaactgggaccaaggtcaccgtcctacgtcacgcccaaggcccaacccnctcgtccacctccgtcgttccccgccctcctccacgttacgacttccgactcgacggcggtccg

SEQ ID NO: 281234 - DNA, 530 bp, Homo sapiens
  misc_feature: GYAE6OF02F1RC3.38.38.D05.1.454.CMB.1.raw
  modified_base (349)..(349): a, c, t, g, unknown or other
  misc_feature (349)..(349): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcctgacctatttcngggcctccgaggctgaggacgagctgtaattttatgctctcatatacagcagcacgcctacccttatcgttcttacggactcggaccaggtccaccgtcctacgtcacgcccaacgcccaacccnctcgtccactcgtcgttcccnccctcctcacgtcgactccgactcggacgcggtcg

SEQ ID NO: 281235 - DNA, 514 bp, Homo sapiens
  misc_feature: GYAE6OF02GHZ4E.38.38.D05.1.454.CMB.1.raw
  modified_base (406)..(406): a, c, t, g, unknown or other
  misc_feature (406)..(406): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttcactcgcttctctggctccaagtttggcacacggctcctgaccattctgggctccaggctgagacgaggctagattttatgctctcatatacaggcagcagcacccgttancgttctcggaactgggaccaggtcaccgtctacgtcagcccaagcccaacccactcgtcactctgttccccaccttcctcacgtcgacttccgactcgagtcgggtcg

SEQ ID NO: 281236 - DNA, 527 bp, Homo sapiens
  misc_feature: GYAE6OF02G39Q4.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctccaagtttgcaacacggcctcctgaccatttctgggctccgaggctggaggacgaggctgtaattttatgctcctctatatacaggcagcagccacccttatgtcttacggaactgggacctaaggtcaccgtcctacgtcacgcccaacggcccaacccactgtcactctcgttcccaccctcctccacgtcgactcgactgacgcggtcg

SEQ ID NO: 281237 - DNA, 524 bp, Homo sapiens
  misc_feature: GYAE6OF02HSEFH.38.38.D05.1.454.CMB.1.raw
  modified_base (379)..(379): a, c, t, g, unknown or other
  misc_feature (379)..(379): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctcaagtttggcaacacggcctccctgaccatttctgggctccaggctgagacgaggctgaattttntgctcctcatatacaggcagcagcacccttatcgtcttcggaactggaccaagtcaccgtcctacgtcacgcccaacgccaacccactcgtcactcctcgttccccaccctcctaccacgtcgactccgacgtcgacggcggtcg

SEQ ID NO: 281238 - DNA, 520 bp, Homo sapiens
  misc_feature: GYAE6OF02FUQT4.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggctccaggctgaggacgaggctgaatttttatgctcctcatatacaggcagcagcacccttatgtcttcggaactgggaccaaggtcaccgtcctacgtcagcccaaggcccaacccactcgtcactctcgttcccgccctcctcacgtcgactccgactgacgcggcg

SEQ ID NO: 281239 - DNA, 534 bp, Homo sapiens
  misc_feature: GYAE6OF02G8B18.38.38.D05.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggcctcaggggtttctactcgcttctctggctccaagtttggcaacacggcctcctgacctatttcngggctccaggctgaggacgaggctgtaattttattgctcctcatatacaggcagcagccaccccttatcgttcttacggaactcgggaccaaggtccaccgtccgtacgtcacgcccaacggcccaacccactcgtcacctcgtcgttcccgccctcctcctcgtacgctccgactcgagcggcg

SEQ ID NO: 281240 - DNA, 468 bp, Homo sapiens
  misc_feature: GYAE6OF02IFWAR.38.38.D05.1.454.CMB.1.raw
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
  modified_base (457)..(468): a, c, t, g, unknown or other
  misc_feature (457)..(468): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgtaattttatgctcctcatatacaggcagcagccacccctttatcgtcttcggaactgggaccaaggtcaccgtcctacgtcacgcccaaggcccaaccccntcgtcactctcgttccccaccctctcacgtcgatccgactgacgcgggctggcaaggcnatagnnnnnnnnnnnn

SEQ ID NO: 281241 - DNA, 573 bp, Homo sapiens
  misc_feature: GYAE6OF02IE9EW.38.38.D05.1.454.CMB.1.raw
  modified_base (188)..(188): a, c, t, g, unknown or other
  misc_feature (188)..(188): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
  modified_base (519)..(519): a, c, t, g, unknown or other
  misc_feature (519)..(519): n is a, c, g, or t
tcagtcgatcacgtcacgaccggtgctcgatttagtatctgatagttgggtttgggggctttgcctgggctctgctgctctcaccctctcactcagggcacagggtcctgggccagtctgccctgactcagcctgcctccgtgtctgggtctcctggacagtcgatcaccatctcctgcactgggaancagtagtgactagtttgggtgttaataactattgtcttacctggtaaccaacaacataccaggacaaaacgcccccaaaataatccattttatcgacgtcaactctatcggccctcaggggtttctactcgcttctctggctccaagtttgctaacacggcctcctgtacctagtttcngggctccgagtctggagacgagctgtaatttttntgcttcctatattatacgagcagcacgctaccccttatcgttcttcggaactcgggaccaaaggtccaaccgttccgtacgtcaaccgtccgaacggacccaacccctagtcgtaccncttccgtcgttaccccgcctccctcgacgttgacttccgactgacggtcggtcg

SEQ ID NO: 281242 - DNA, 554 bp, Homo sapiens
  misc_feature: GYAE6OF02H4GO8.38.38.D05.1.454.CMB.1.raw
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcgagggtttcactcgcttctctggctctaagtttgacaacacggcctcctgaccatttcgngggctccgaggctaggacggacgaggcttagtaattttttagtcgtctcctctattatacgaggcagcagcctaaccccttntcgttcttacggaactgggaaccaggtccaccgttcctacgtcacgacccaacggaccaacccgactcgtcactccgtcgttccccgcctccctacacggtgactccgactcggacggcggtcg

SEQ ID NO: 281243 - DNA, 621 bp, Homo sapiens
  misc_feature: GYAE6OF02IBW67.38.38.D05.1.454.CMB.1.raw
  modified_base (195)..(195): a, c, t, g, unknown or other
  misc_feature (195)..(195): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagtcgatcacgtcacgaccggtgctcgatttagtatctgatagttgggtttgggggtcgtttggtccgtgggcgtctgctgctctcaccctcctcactcagggcacagggtcctgggcccagtctgccctgactcagcctgcctccgtgtctgggtctcctggacagtcgatcaccatctcctgcactggaancagtagtgacattggtggttataactatgtctctggtaccaactaacacccaggccaaaagccccaaaactccatcaagtttatgacgtcactcattcggccctcgaggggtttcctactccgcttctctggacttcccaagtttggccaaacgacggtcctcctgaccctattttcgcgggctcccaggcctggaggacgaggctgtaaatttttngtctcctnattatacagctagcagccacccttatgtcgttaccgaactgggaaccctaaggtcctaaccgtaccgtaccgttacacgttacccgaacggacccaaaccccctagtacgtcctaacccttccgttaccggtttccccggtccccttcccgtacccgtacggttcgaccgttaccgaaccggttggaccggttccgggcgg

SEQ ID NO: 281244 - DNA, 510 bp, Homo sapiens
  misc_feature: GYAE6OF02HE7JZ.38.38.D05.1.454.CMB.1.raw
  modified_base (376)..(376): a, c, t, g, unknown or other
  misc_feature (376)..(376): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaagccccaaactcatcatttatgacgtcactcatcggcctcaggggtttctactcgcttctctggctccaagtttgcaacacggcctcctgaccatttctgggctccaggctgagacgaggctgaattttntgctcctctatatacaggcagcagccacccttatgtcttcggaactggacaagtcaccgtcctacgtcagcccaaggcccaacccatcgtcactctcttcccaccctcctcacgtgactcgactgacgcggtcg

SEQ ID NO: 281245 - DNA, 528 bp, Homo sapiens
  misc_feature: GYAE6OF02H83BH.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcctgaccattctgggctccaggctgaggacgaggctgtaattttattgctcctcatatacaggcagcagccacccttatcgtcttacggaactgggaacctaaggtccaccgtcctacgtcagacccaaggcccaacccactcgcactctcgttccccgccctcctcacgtgactccgactcggacgcggtcg

SEQ ID NO: 281246 - DNA, 482 bp, Homo sapiens
  misc_feature: GYAE6OF02JLNTR.38.38.D05.1.454.CMB.1.raw
  modified_base (333)..(333): a, c, t, g, unknown or other
  misc_feature (333)..(333): n is a, c, g, or t
  modified_base (455)..(455): a, c, t, g, unknown or other
  misc_feature (455)..(455): n is a, c, g, or t
  modified_base (458)..(482): a, c, t, g, unknown or other
  misc_feature (458)..(482): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcagggtttcactcgcttctctggctccaagtttgcaacacggcctccctgaccatttctgggctccaggctgaggacgaggctgtaattttattgcttcctcatatacaggcagcagccaaccccttntcgtcttcggaactgggaccaaggtcaccgtctacgtcacgcccaaggcccaaccccgatcgtaccactctcgttccccgccttcctacacgtgactccgactgagcggctggcaggcgcancgnnnnnnnnnnnnnnnnnnnnnnnnn

SEQ ID NO: 281247 - DNA, 534 bp, Homo sapiens
  misc_feature: GYAE6OF02ICN5Y.38.38.D05.1.454.CMB.1.raw
  modified_base (288)..(288): a, c, t, g, unknown or other
  misc_feature (288)..(288): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctnaggggttttctactcgcttctctggctccaagtttggcaacacggcctccctgaccatttctgggctccaggctggaggacgaggctgtaatttttatgtctcctcatatacaggcagcagctacccctttatcgtcttcggaactgggaccaaggtccaccgtcctacgtcacgcccaacggcccaaacccgctcgtcacctcgtcgttccccgccctcctcacgtgactcgactgacgcggtcg

SEQ ID NO: 281248 - DNA, 546 bp, Homo sapiens
  misc_feature: GYAE6OF02IQXTR.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaaagccccaaactcatcatttatgacgtcactcatcggccctcaggggtttctactcgcttctctggctccaagtttggcaacacggcctccctgacctatttctgggctccaggctgaggacgaggctgtaatttttatgactcctcatatacaggcagcagcctaccccttagtcgttcttacggaactcgggaacctaaggtccaccgtcctaccgtcacgcccgaaacggcccaaaccccactcgtcacttcgtcgttccccgccctcctcacgtgtactccgactgaggcggtcg

SEQ ID NO: 281249 - DNA, 514 bp, Homo sapiens
  misc_feature: GYAE6OF02I8FWW.38.38.D05.1.454.CMB.1.raw
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctgctccaagtttgcacacggcctcctgaccatttctgggctcaggctgaggacgagctagattttatgctctcatatacaggcagcagcctacccttatcgttcttcggaactgggacctaaggtcaccgtcctacgtcacgcccaaggccaacccgctgtcactctcgttcccncctctcacgtnactcgactgacgcggtcg

SEQ ID NO: 281250 - DNA, 470 bp, Homo sapiens
  misc_feature: GYAE6OF02GNHMF.38.38.D05.1.454.CMB.1.raw
  modified_base (390)..(390): a, c, t, g, unknown or other
  misc_feature (390)..(390): n is a, c, g, or t
  modified_base (450)..(450): a, c, t, g, unknown or other
  misc_feature (450)..(450): n is a, c, g, or t
  modified_base (456)..(470): a, c, t, g, unknown or other
  misc_feature (456)..(470): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagccccaaggcccaaccccnctgtcactctcgttccccaccctcctcacgtgactcgactgacgcgggctggcaagggcncatagnnnnnnnnnnnnnnn

SEQ ID NO: 281251 - DNA, 489 bp, Homo sapiens
  misc_feature: GYAE6OF02GB67M.38.38.D05.1.454.CMB.1.raw
  modified_base (458)..(458): a, c, t, g, unknown or other
  misc_feature (458)..(458): n is a, c, g, or t
  modified_base (465)..(489): a, c, t, g, unknown or other
  misc_feature (465)..(489): n is a, c, g, or t
tcagtcgatcacgtcacgaccggtgctcgatttagtatctgatagttgggtttgggggcttcttctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatcgtcttcggaactgggaccaaggtcaccgtcctacgtcacgcccaaggcccaaccccactcgtcacctcctcgttccccaccctcctccacgtgactccgactcggagcgggctcggcaacggcncagtagnnnnnnnnnnnnnnnnnnnnnnnnn

SEQ ID NO: 281252 - DNA, 465 bp, Homo sapiens
  misc_feature: GYAE6OF02G6HXO.38.38.D05.1.454.CMB.1.raw
  modified_base (447)..(447): a, c, t, g, unknown or other
  misc_feature (447)..(447): n is a, c, g, or t
  modified_base (453)..(465): a, c, t, g, unknown or other
  misc_feature (453)..(465): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtcctacgtcagcccaaggcccaaccccatcgtcactctcgttccccgccctcctcacgtgactcgactgacgcgggctggcaaggcncatagnnnnnnnnnnnnn

SEQ ID NO: 281253 - DNA, 295 bp, Homo sapiens
  misc_feature: GYAE6OF02IAOZW.38.38.D05.1.454.CMB.1.raw
  modified_base (288)..(295): a, c, t, g, unknown or other
  misc_feature (288)..(295): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccaccctcctcacgtgatcgactgagcgggctggcaaggcgcatagnnnnnnnn

SEQ ID NO: 281254 - DNA, 303 bp, Homo sapiens
  misc_feature: GYAE6OF02H9KRT.38.38.D05.1.454.CMB.1.raw
  modified_base (295)..(303): a, c, t, g, unknown or other
  misc_feature (295)..(303): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaatttttattgctcctcatatacaggcagcagcaccccttatgtcttcggaactgggaccaaggtcaccgtcctacgtcagcccaaggccaaccccactgtcactctgttcccgccctctcacgtgatcgactgagcgggctggcaaggcgcatagnnnnnnnnn

SEQ ID NO: 281255 - DNA, 593 bp, Homo sapiens
  misc_feature: GYAE6OF02IS71X.38.38.D05.1.454.CMB.1.raw
  modified_base (418)..(418): a, c, t, g, unknown or other
  misc_feature (418)..(418): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaaacaacacccaggcaaacgccccaaactcatcatttatgacgtcactcagtccggccctcgtaggggtttctactcgtcttctctcggctcctaagtttggacaacaccggcctccctacgacctatttcgtcgggtcctccgaggctggaacggacgaggctagtaatttttatcgtcttcctanaatactacgagcagcacgtcctacccttatcgttcgttacgaacgtacggaaccaacggtcctacccgtacctacgtaccgacgacccgaaacgcccaaacccctactccgtctaacctccgttccgttccccgcccttcctccgacgtacgactccgtacgtcgacggcggtcg

SEQ ID NO: 281256 - DNA, 547 bp, Homo sapiens
  misc_feature: GYAE6OF02JTG1Z.38.38.D05.1.454.CMB.1.raw
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagtcgatcacgtcacgaccggtgctcgatttagtatctgatagttgggtttgggggctttgcctgggctctgctgctcctcaccctcctcactcagggcacaggggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggcctcgagggtttctactcgcttctctggctcaagttgcacacggcctcctgacctattcnggctcgaggctgaggacgngctgtaattttntcgctcctnatatacaggcagcacgccacccttatcgttacttacggaactggaacctaagtccaccgtcctacgtcgacgacccaacggacccaacccactcgcctactccgtccgttcccacccttcctacgtaccgtcgtacgtccgacgtcggacggtccgggtacg

SEQ ID NO: 281257 - DNA, 527 bp, Homo sapiens
  misc_feature: GYAE6OF02FZTL0.38.38.D05.1.454.CMB.1.raw
  modified_base (494)..(494): a, c, t, g, unknown or other
  misc_feature (494)..(494): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcctgaccatttctgggctccaggctgagcgaggctgtaattttatgcttcctcatatacaggcagcagctaccccttatcgttcttcggaactcgggaccaaggtcaccgtcctacgtcacgcccaagcccaacccactcgtccactcgtcgttccccnccctcctcacgtcgactccgactggacgcggcg

SEQ ID NO: 281258 - DNA, 573 bp, Homo sapiens
  misc_feature: GYAE6OF02JT6CJ.38.38.D05.1.454.CMB.1.raw
  modified_base (164)..(164): a, c, t, g, unknown or other
  misc_feature (164)..(164): n is a, c, g, or t
  modified_base (367)..(367): a, c, t, g, unknown or other
  misc_feature (367)..(367): n is a, c, g, or t
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
  modified_base (573)..(573): a, c, t, g, unknown or other
  misc_feature (573)..(573): n is a, c, g, or t
tcagtcgatcacgtcacgaccggtgctcgatttagtatctgatagttgggtttgggggcgtttgcctgggctctgctgctcctcaccctcctcactcagggcacagggtcctgggcccagtctgccctgactcagcctgcctccgtgtctgggtctcctggacngtcgatcaccatctcctgcactggaagcagtagtgacattggtggttataactatgtctctggtaccaacaacacccaggcaaacgccccaaactcatcattttatgacgtcactcatccggaccctctaggggtttctactcgcctttcacgtcggctacctaaggtttggcaacacggccctccctgaaccctagtttcgngggcctccagggctggaggacgagcttagtaattttntcgctctcataatacgacgnagtcacgtaccctacccttatcgttccttacgggaacttacgggaccaaggtcctaccgtcctacgtcacgacccgaacggacccaccgtactctcgacttccgtacggtccctcctccgtcacgtagtactccgactcggacgcggtn

SEQ ID NO: 281259 - DNA, 644 bp, Homo sapiens
  misc_feature: GYAE6OF02G0U1H.38.38.D05.1.454.CMB.1.raw
  modified_base (165)..(165): a, c, t, g, unknown or other
  misc_feature (165)..(165): n is a, c, g, or t
  modified_base (176)..(176): a, c, t, g, unknown or other
  misc_feature (176)..(176): n is a, c, g, or t
  modified_base (269)..(270): a, c, t, g, unknown or other
  misc_feature (269)..(270): n is a, c, g, or t
tcagtcgatcacgtcacgaccggtgctcgatttagtatctgatagttgggtttgggggtcgtttgcctgggcgtctgctgctcctcaccctcctcactcaggcacagggtcctgggcccagtctgccctgactcagcctgcctccgtgtctgggtctcctggacngtcgatcaccntctcctgcactggaagcagtagtgacattggtcgttataactatgtctcctggtacaacaacaccaggcaaacgccccaaactcatcatttannacgtcactcatcggcctcagggtttcactcgcttctctggctcaagtttcgcaacgcggacctctacgaccctattccgtgggcctccgaggcctggacggacgaggctaggtaaatttttagtgtaccttcctacattacgtaacctagggacacggacacgtacctaccccttaggttaccgtttcgttaaccggtaacgttacggggaacccgtaaaggttcccaaaccggttccctaaccggttccgaacccgtacccgaaaccggacccctaaaaccccgacgttaccgtacgtacccttcgttacccgttaccccaccccttccctacgtaccgtacggtactccggtaatccggacgccggggtacg

SEQ ID NO: 281260 - DNA, 581 bp, Homo sapiens
  misc_feature: GYAE6OF02FOUEH.38.38.D05.1.454.CMB.1.raw
  modified_base (380)..(380): a, c, t, g, unknown or other
  misc_feature (380)..(380): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctcaagtttggcacacggcctcctgacctattctggctccgaggctgaggacgaggctagtaattttntgctctcatatacaggcacgcacgcctacccctttatcgttaccgttacggaacgtcggggaacctaacggttccgacccggttccgtaccgtccgacgaccccgaacggccccaaaccccgtactacgtccactccgttccgttccccgtccccttcctaccgtacgtcgtacctaccggacctcggacggcgggtaccg

SEQ ID NO: 281261 - DNA, 572 bp, Homo sapiens
  misc_feature: GYAE6OF02GZJWH.38.38.D05.1.454.CMB.1.raw
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (544)..(544): a, c, t, g, unknown or other
  misc_feature (544)..(544): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggacaaacgccccaaactcatcatttatgacgtcactcatcggccctcgaggggtttcactcgtcttctctggctcaagtttggcaacncggtcctcctgacctattcngggctcgaggctgacgacgaggtctagtaattttatcgctctcatactacgagctagcagcctaccccttatcgttccttacggaactcgggaaccaacggtcctacccggttcctaccgtcgaacgacccaacggacccaaccccacttcgtacctacgtcgtccgttacccctaccctccctcaaccgttnaccgttccgacgtcgacggtccggtcgg

SEQ ID NO: 281262 - DNA, 570 bp, Homo sapiens
  misc_feature: GYAE6OF02IFV64.38.38.D05.1.454.CMB.1.raw
  modified_base (280)..(280): a, c, t, g, unknown or other
  misc_feature (280)..(280): n is a, c, g, or t
  modified_base (372)..(372): a, c, t, g, unknown or other
  misc_feature (372)..(372): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (532)..(532): a, c, t, g, unknown or other
  misc_feature (532)..(532): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttaataacttatgtctaccgtggtaacccaaacaaccacccaggcctaaaacgcccccaaatcatcatttangacgtcactcatcggcccttcgaggggtttcctacgtcgtcttctctaggctcctaagtttcggacaacacggcctccctgacctagtttcncgggactccaggctggacggacgaggctagtaatttttntgtctctacatatacngcagcacgcctaccttntctcttaccgacgtcggaacctaaggtcctaaccgtcctacgtcacgcccaacggcccaaccctcgtactccactccgtcgttccccncctccctcgtcgtcgactccgactcggacggcggtccg

SEQ ID NO: 281263 - DNA, 535 bp, Homo sapiens
  misc_feature: GYAE6OF02I0HYO.38.38.D05.1.454.CMB.1.raw
  modified_base (390)..(390): a, c, t, g, unknown or other
  misc_feature (390)..(390): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcattatgacgtcactcatcggcctcagggtttcactcgcttctctggctcctaagtttggcaacacggcctccctgaccattctggctccaggctgaggacgaggctgaattttatgctcctcatatanaggtcagcagccacccttatgtcttacgactgggaccaaggtccaccgtcctacgtcacgccaacggccaacccactcgtaccacgtccgtcgttaccccgccctcccgtacgacgtcgactccgacgtcggacggccgggtacg

SEQ ID NO: 281264 - DNA, 528 bp, Homo sapiens
  misc_feature: GYAE6OF02GMBP1.38.38.D05.1.454.CMB.1.raw
  modified_base (391)..(391): a, c, t, g, unknown or other
  misc_feature (391)..(391): n is a, c, g, or t
  modified_base (477)..(477): a, c, t, g, unknown or other
  misc_feature (477)..(477): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaaacgccccaaactcatcatttatgacgtcactcatcggccctcaggggtttctactcgcttctctggctccaagtttggcaacacggcctcctgaccatttctgggctccaggctgaggacgaggctgtaattttatgctcctnatatacaggcagcacgcctacccttatcgtcttcggaactcgggaccaaggtccaccgtcctacgtcacgcccaaggcccaacccnctcgtcactctcgttcccaccctcctctacgtgactcgactgacgcggtcg

SEQ ID NO: 281265 - DNA, 513 bp, Homo sapiens
  misc_feature: GYAE6OF02JZI0R.38.38.D05.1.454.CMB.1.raw
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (458)..(458): a, c, t, g, unknown or other
  misc_feature (458)..(458): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggttctactcgcttctctgctcagttgcacncgcncctgacctattcnggctcaggctgagacgagctagtaattttntcgtctctcatatacagcagcagcctacccttntcgtcttcgaacgtcggaccagtcaccgtcctacgtcacgccaacggcccaacccnctcgcactccgtcgtacccacctctccacgtcgactccgactcggacgcggtacg

SEQ ID NO: 281266 - DNA, 742 bp, Homo sapiens
  misc_feature: GYAE6OF02GGPDL.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcacgtccgtcctacgggttacggttactaccgtcttccttcctcggtcgtcctaacgtttaggttcgaaccaaccggacccggtcccttccgtaccgtactttacgttcgggtcgtccctacggacgtcgtacgggaacggaacggacggtacgtaagttttaattttagtccgttccctcctaactaattaactaacgggcgtacgacgaccgtaccgtaccccttaaccgtttgtccgtttaccggtaaccggtacgggtacccggaaaccggtacgtacccgttacccgttaccgttaccgacgtaacccccggaaccggtaaacccgaaccccccgtaaacctaccgttaccgtacccttaccgtttcccgtttccccgtaacccccttaccccgttaccctacccgtacggttacgttacccgtaaccggtacgtacggggtacccggcggttacccgg

SEQ ID NO: 281267 - DNA, 537 bp, Homo sapiens
  misc_feature: GYAE6OF02F8M5R.38.38.D05.1.454.CMB.1.raw
  modified_base (384)..(384): a, c, t, g, unknown or other
  misc_feature (384)..(384): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcctgacctattctgggctccgaggctgacggacgaggctgtaatttttntgctcctcatatacaggcagcagccacccttatcgttcttcggaactggaccaaggtcaccgtcctacgtcacgacccaacggcccaacccactcgtccactcgtcgttccccgccctcctccgacgttcgactccgacgtcgacggcggtcg

SEQ ID NO: 281268 - DNA, 460 bp, Homo sapiens
  misc_feature: GYAE6OF02F68NA.38.38.D05.1.454.CMB.1.raw
  modified_base (444)..(444): a, c, t, g, unknown or other
  misc_feature (444)..(444): n is a, c, g, or t
  modified_base (449)..(460): a, c, t, g, unknown or other
  misc_feature (449)..(460): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggcccaacccactcgtcactctgttccccacctcctcacgtgactcgactgagcgggctggcaggcncatgnnnnnnnnnnnn

SEQ ID NO: 281269 - DNA, 602 bp, Homo sapiens
  misc_feature: GYAE6OF02HMA9E.38.38.D05.1.454.CMB.1.raw
  modified_base (519)..(519): a, c, t, g, unknown or other
  misc_feature (519)..(519): n is a, c, g, or t
tcagtcgatcacgtcacgaccggtgctcgatttagtatctgatagttgggtttgggggctttgcctggactctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctcctggtaccaacaacacccaggacaaacgccccaaactcatcatttatgacgtcactcatcggccctccgtagggtttctactcgcttctctggctccaagttggcaacacgcctcctgacctattcgtgggcctccgaggctgaggacgaggctagtaattttatcgtcttacctctaatactacgacggacagcacgacctacccttatcgttaccgtttaccggaacgtacgggaacctaaggtccctaaccggttccctacgtaccacgcccgaaacggacccctaaaccccncgtaccgtcctaaccttccgttaccgttcccccacccttccctccgtaccgtcgtacgtccgtacgtacggtacggcgggtcg

SEQ ID NO: 281270 - DNA, 636 bp, Homo sapiens
  misc_feature: GYAE6OF02FO5WB.38.38.D05.1.454.CMB.1.raw
  modified_base (230)..(230): a, c, t, g, unknown or other
  misc_feature (230)..(230): n is a, c, g, or t
  modified_base (288)..(288): a, c, t, g, unknown or other
  misc_feature (288)..(288): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
tcagtcgatcacgtcacgaccggtgctcgatttagtatctgatagttgggtttgggggctttgcctgggctcttgcgtgcgtcctcaccctcctccacgtcagggcacagggtacctgggcccagtctggccctgactcagcctgcctccgtgtctgggtctccgtggacagttcgatcaccatctcgtgcactggaagcagtagtggacagttcggtggttataacctntcgtctcctcggtaccaacaacgacccaggccaaacgcccccaaatcactcatttacngacgtcacctcatcggccctcgagggggtttcctaccgtcggcctttctccgtgggtcctaccgtaaagttttcgaccaaaccgaccggtcccttcccgtcgacctagttttccggngggtcctaccgagggctaggaaggtacgnggctagtaatttttatcgtcctcctctatatacaggcagcagcctacccttatcgttcttacggactcgggacctaaggtccaccgttcctacgtccacgacccgaacggaccaaaccccgactcgtaccacctccgttccggttaccccgtccccttaccctccgacgttacgacgttccgacgtcggacggtccgggtcg

SEQ ID NO: 281271 - DNA, 522 bp, Homo sapiens
  misc_feature: GYAE6OF02IA6IB.38.38.D05.1.454.CMB.1.raw
  modified_base (503)..(503): a, c, t, g, unknown or other
  misc_feature (503)..(503): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttctgggcctccaggctgaggacgaggctgatttttattgctcctcatatacagcagcagccacccttatcgtcttcggaactgggaccaggtcaccgtcacgtcagcccaaggccaacccactgtccactcgtcgttacccgccctccgtccacgtnactccgactgacgcggtcg

SEQ ID NO: 281272 - DNA, 544 bp, Homo sapiens
  misc_feature: GYAE6OF02HKFVV.38.38.D05.1.454.CMB.1.raw
  modified_base (269)..(269): a, c, t, g, unknown or other
  misc_feature (269)..(269): n is a, c, g, or t
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
  modified_base (480)..(480): a, c, t, g, unknown or other
  misc_feature (480)..(480): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttangacgtcactcatcggccctcgagggtttctactcgcttctctggctcaagtttggcaacncgcctcctgacctattctgggctccagctggaggacgnggctgtaattttagtcgtctcctcattatactaggcagcacgcctaacccttatcgtcttcggaacgtcgggaacctacgtccaccgtctacgcacgaccaacggccaacccnctgtcctactccgtccgttcccgccctcctccgtacgtcgactccgactcgacggcggtaccgg

SEQ ID NO: 281273 - DNA, 572 bp, Homo sapiens
  misc_feature: GYAE6OF02J16FU.38.38.D05.1.454.CMB.1.raw
  modified_base (489)..(489): a, c, t, g, unknown or other
  misc_feature (489)..(489): n is a, c, g, or t
tcagtcgatcacgtcacgaccggtgctcgatttagtatctgatagttgggtttgggggagagaggagccttagccctggattccaaggcctatccacttggtgatcagcactgaccaccgaggattcaccatggaactggggctccgttgggttttccttgttgctattttagaaggtgtccagtgtgaggtgcagctggtggagtcgtgggggaggcctggtcaagccgtggggggtccctgagactctcctgtgagtctctggattctccttcagtacttatagcatgaattgggtccgccagactccgaggggaaggggctggaggtgggtcgcattcatcagtactacgtgggtagtttcatatactacgcagactcggtgaacgggccgtatcacctattccagagacaacgaccgaagaggtcactagtatctgacaataggacacgacgtgagtgtacgacgacgacggcgtgtaaaaagtnttactgtcgcgtacgtacgtaaccggtaaacgttcgttaacgtagtttagttaggtagtagtacgtactaccgtcccgtacgg

SEQ ID NO: 281274 - DNA, 648 bp, Homo sapiens
  misc_feature: GYAE6OF02ITAWW.38.38.D05.1.454.CMB.1.raw
tcagtcgatcacgtcacgaccggtgctcgatttagtatctgatagttgggtttgggggctttgcctgggctctgctgctcctcaccctcctcactcagggcacaggggtcctgggcccagtctgccctgactcagcctgcctccgtgtctgggtctcctggacagtcgatcaccatctcctgcactggaagcagtagtgacattggtgttataactatgtctctggtaccaacacaccaggcaaacgccccaaactcatcatttaatgacgtcactcactcggccctcgaggggtttctactcgtcttctctggctcctaagttggacacacggcctcctcgacctactttcgcgggtcctaccgaggtctaggaggacggaggcttagtaatttttactcgtaccttccgtactaattaacttaacgaggtacagtcacgtaccctacccgttattcgttaccgttacggaaaccgtgggaacccgtaagggtaccctaacccggttcccgtaacgttacccaccggacccgtaaaccgggaccccaaaccccgtactccgtacccacgttacccgttcgttacccccgtacccttccctaccgtaaccgtcgtacctaccggtacgtcggtaccggtcggtaccgg

SEQ ID NO: 281275 - DNA, 890 bp, Homo sapiens
  misc_feature: GYAE6OF02GZICD.38.38.D05.1.454.CMB.1.raw
  modified_base (334)..(334): a, c, t, g, unknown or other
  misc_feature (334)..(334): n is a, c, g, or t
tcagtcgatcacgtcacgaccggtgctcgattttagtatctgatagttggggtttagggggggcgtttcgccgtgggctctagctggctcctcaccctctcgacctcgaggccacagggttcctccgggcccagtctcgccctgactcaggcctgccgtcggtcgtcctgggtctaccgtggacagtcgatccaccctagtctcctggccacctgggaacgcgacggtacgtggactagttcgggttggttactaaccgtgtcgtactaccgtgggtaacccaacgaaccaaccgaaggaccaaacggccccctaaattcgaactactagttancgacggtccacgtccagttccggaccttgagggtttctaacgtacgccttcgtcgtggcctccgtaaggtttcgggactaaccgtaccggtcccgtacccgtacggtacccttacgttttccggtacggggtcccttacccggtaagggtcccgttacgggaacggggaacccggtaacggggtaccgtttaacgggtttaaaccgtttttttaacggtttccgggtaacccttttaacccgtttaccgttaaacgtttaacggttaaacccggtacgggaaccgttaacggaaccggtaaccgggtacccgttaaccccggttttagttccggtttaaccgtttaccgggtaaaccgttaccggggtaaaccctaaacgggttaccgtaacccggttaccgtaccggttaaccgaacggttaccccgtaaacgggtcccctaaccggtacgttaccggtaccggtaccgttaccgttaccggttccccgtacccttacccgtacccggtacgtacggaccgtaccggtaccggtcggtaccggtcccggtaccgg

SEQ ID NO: 281276 - DNA, 675 bp, Homo sapiens
  misc_feature: GYAE6OF02GG962.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcattatgacgtcactcatcggccctcgtaggggtttctactcgcttctctgctctaagtttgcaacgacggtcctccctgacctatttcgtcgggcctccgaggtctggacggacgaggcctagttaatttttatcgtcctaccgtactaatatacgaggctagcacgccttaccccttagttcgttaccgttaccgggaaacgtacgggtaacctaacgggttacccgaacccgttacccgttaaccggttccaaccgggtaccccgtaaaccgggaaccccctaaacccccgtacgttccggttaccctaaccgttccgtttacccggtttccccgaccccgtttacccgttaccgtaacccgttacggtaaccgttaccggtaacgtttcgggacggtcccgggtaccgg

SEQ ID NO: 281277 - DNA, 534 bp, Homo sapiens
  misc_feature: GYAE6OF02IPCLD.38.38.D05.1.454.CMB.1.raw
  modified_base (216)..(216): a, c, t, g, unknown or other
  misc_feature (216)..(216): n is a, c, g, or t
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactntgtctctggtaccaacacaccaggcaaacgccccaaactcatcattatgacgtcactcatcggcctcgacgggtttctactcgcttctctggctccaagttgcaacncggctcctcgactattcgtgggctccgaggtctgacgacgaggctgtaattttatcgtctctnatatacgagacagcagcctacccttatcgtcttacggactcggaccaacgtcaccgtccgtacgtcacgaccaacggacccaacccactcgtacctactcgtcgttcccaccctctactacgtcactccgtactgtacggcggtacgg

SEQ ID NO: 281278 - DNA, 567 bp, Homo sapiens
  misc_feature: GYAE6OF02GHX00.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaaactcatcatttatgacgtcactcatcggccctcaggggtttctactcgcttctctggctccaagtttggcaacacggcctccctgacctatttctgggctccgaggctgaggacgaggctgtaattttatcgctcctcatatacagcagcagcctaacccttatcgttacgttccggaacgtcgggaacctaacgggtccacccgttccgtaccgtcgacgcccgaaacggcccaaccccactcgtcaccttccgtcgttccccgtcccctcctccaccgtcgacgttccgacgtcggacggtcgggtcg

SEQ ID NO: 281279 - DNA, 298 bp, Homo sapiens
  misc_feature: GYAE6OF02GC5Z2.38.38.D05.1.454.CMB.1.raw
  modified_base (291)..(298): a, c, t, g, unknown or other
  misc_feature (291)..(298): n is a, c, g, or t
tcagtcgatcacgtcacgaccggtgctcgatttagtatctgatagttgggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggcccaaccccactgtcactctcgttccccgccctcctcacgtgatcgactgagcgggctggcaaggcgcatagnnnnnnnn

SEQ ID NO: 281280 - DNA, 556 bp, Homo sapiens
  misc_feature: GYAE6OF02IUN7H.38.38.D05.1.454.CMB.1.raw
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
tcagtcgatcacgtcacgaccggtgctcgatttagtatctgatagttggggtttgggggctttcgcctgggctctggcgtgctcctcaccctcctcactcagggcacagggtcctcgggcccgagtctgccctagacttcagcctagcctccgtgtctgggtctcctggacagtcgtaattcaccagtctcctgccacgtggaagcagtagtgacagttggtagttataacctntgtctccgtggtaccaanaaccacccgaggacaaacggtccccaaacgtcatcatttactgacgtcactcactccggccctcgtaggggtttctactcgtcttctctggctcctagttcggcacacggcctcctgacctagttctgggctcaggtctgagacgagcgtagtaattttgtctactcctcatatctagctagcagctaccttntntcttcgactcggacagctaccgtccacgtcacgtaccgacgccctaacccgctacgtccactctacttcccacctccgtcgaccgtgacgtccgactcggacgcggtcg

SEQ ID NO: 281281 - DNA, 538 bp, Homo sapiens
  misc_feature: GYAE6OF02HEE4F.38.38.D05.1.454.CMB.1.raw
  modified_base (402)..(402): a, c, t, g, unknown or other
  misc_feature (402)..(402): n is a, c, g, or t
  modified_base (473)..(473): a, c, t, g, unknown or other
  misc_feature (473)..(473): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctccaagtttggcaacaccggcctcctgacctatttctgggctccaggctgacggacgagctagtaattttattgtctcctcatatacngcagcagccacccttatcgttcttcggactggaccaggtcaccgtctacgtcacgcccaacgcccaacccnctcgtccacttccgtcgttaccccgcccttcctccgacgttcgactccgactggacggcgggtcg

SEQ ID NO: 281282 - DNA, 560 bp, Homo sapiens
  misc_feature: GYAE6OF02H5FEH.38.38.D05.1.454.CMB.1.raw
  modified_base (326)..(326): a, c, t, g, unknown or other
  misc_feature (326)..(326): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggccaaagcccccaaatcatcatttatgacgtcactcatcggccctcagggtttcactcgcttctctgctccagtttcgcaacncggcctcctgacctatttcgtgggctccgaggctaggacggacgaggctagtaatttttagtcgtctcctactattactacgaggcagccagcctacccttatcgtacttcggaacgtcgggaccaggtccaccgttcctacgtcacgcccaacggcccaaccctactcgtccacttccgtcgttaccccaccctccctacaccgttgactaccgactcggacggccggtaccg

SEQ ID NO: 281283 - DNA, 504 bp, Homo sapiens
  misc_feature: GYAE6OF02F2Z9E.38.38.D05.1.454.CMB.1.raw
  modified_base (398)..(398): a, c, t, g, unknown or other
  misc_feature (398)..(398): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (478)..(500): a, c, t, g, unknown or other
  misc_feature (478)..(500): n is a, c, g, or t
  modified_base (502)..(504): a, c, t, g, unknown or other
  misc_feature (502)..(504): n is a, c, g, or t
tcagtcgatcacgtcacgaccggtgctcgatttagtatctgatagttgggtttgggggcgtttcgtctggggtctcctggacagtcgatcaccatctcctgcactggaagcagtagtgaccattggtggttataactatgtctcctggtaccaacaacacccaggcaaagcccccaaactcatcatttatgacgtcactcatcggccctcaggggtttctactcgcttctctggctccaagtttggcaacacggcctccctgacctatttctggctccaggctgaggacaggctgaattttatgctcctcatatacaggcagcagcctaccccgttatgtcttcggaactggaccaaggtcaccgtcctacgtcacgccccaacggcccaaccccgtntcgtccacctccgttcgttccccgccctcctcacggtnactccgactggacgccgggactgggacaaggccgnagtacgnnnnnnnnnnnnnnnnnnnnnnncnnn

SEQ ID NO: 281284 - DNA, 489 bp, Homo sapiens
  misc_feature: GYAE6OF02IBT6A.38.38.D05.1.454.CMB.1.raw
  modified_base (457)..(457): a, c, t, g, unknown or other
  misc_feature (457)..(457): n is a, c, g, or t
  modified_base (464)..(465): a, c, t, g, unknown or other
  misc_feature (464)..(465): n is a, c, g, or t
  modified_base (467)..(489): a, c, t, g, unknown or other
  misc_feature (467)..(489): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggctccctgaccatttctgggctccaggctgaggacgaggctgaatttttatgctcctcatatacaggcagcagcctaccccttatgtcttcggaactgggaccaaggtcacccgtcctacgtcacgacccaacggacccaacccccatcgtcactctcgttccccaccctcctcacgtgactcgactgacgcgggctcggcaaggccncagtacnncnnnnnnnnnnnnnnnnnnnnnnn

SEQ ID NO: 281285 - DNA, 657 bp, Homo sapiens
  misc_feature: GYAE6OF02H6NJF.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattgggtggttaataactatgtctccgtaggtaaccaaacaaccacccgaggaccaaaacgacccccaaatcatctaatttatgacgtcactcactcggccctgagggtttcactcgcttctctgctcagtctgacacacgcctcctagaccctatctcgtcggcctaccaacctgaagacgaggcctacacttattacgttgactacgtctacaattataacaagcagtccgtacgtaccgtttagggtcgttacgggacgggaacgggtaccgtaccgtacggtacccgttacggtttacggaccgttaacggccccgtaaaggtcccgtacccgtccccccggtacgggttacctacccgttcccgttccggtttccccccgtacccccgttaccccttaccggtaccggttacggtaccttacccgggtaccgtttacgggacggtcccgggg

SEQ ID NO: 281286 - DNA, 646 bp, Homo sapiens
  misc_feature: GYAE6OF02HHUCR.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtaggttaataactatcgtcttccgtggtaaccaaacaaccacccgaggaccaaacggacccccaaaactcaatcatttatgacgtcactcatccggccctcaggggtttctactcgcttctcgtggcctcctaagtttggacaacgacggtcctccctgaacctatttcgcgggccttaccgaggcgtggacgggtacgagggacttaggtaatttttacgttcgtacctccgtcaattactaacgagtcagaccagccctaccctttagtcgttcgtttacggaacgtcggggaacctaacggtcccgtaccggttacctaccgttccgaacgacccggaaacgtacccaaaccctacgttcgtaccctactttcccgtccggtttaccccacccttcccgtactacggtcgacctccggactcggacggtcggtaccg

SEQ ID NO: 281287 - DNA, 526 bp, Homo sapiens
  misc_feature: GYAE6OF02G6MQK.38.38.D05.1.454.CMB.1.raw
  modified_base (349)..(349): a, c, t, g, unknown or other
  misc_feature (349)..(349): n is a, c, g, or t
  modified_base (491)..(491): a, c, t, g, unknown or other
  misc_feature (491)..(491): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaaactcatcatttatgacgtcactcatcggccctcaggggtttctactcgcttctctggctccaagtttggcaacacggcctccctgaccattcngggctccaggctgagacgaggctgaattttatgctctcatatacaggcagcagccacccttatgtcttcggaactgggaccaaggtcaccgtctacgtcacgcccaacggcccaaacccactcgtcacctctcggttccccnccctcctcacgtcgactccgactggacgcggtccg

SEQ ID NO: 281288 - DNA, 562 bp, Homo sapiens
  misc_feature: GYAE6OF02HEDWG.38.38.D05.1.454.CMB.1.raw
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttgggtggttaataactatgtctcctggtaccaacaacacccaggcaaagccccaaaatcatcatttatgacgtcactcatcggccctnagggtttctactcgcttctctggctctaagtttgcaacacggcctccctgacctatttcgnggctccgaggctgaggacgnggctagattttatcgctctnattanacnggcagcagcctacccttagtcgttcttacgggaacttcgggaacctaagggtccaacccggttcctacgtcacgaccctaacggcccaaaccctctcgtccacctccgttccgtccccgtccctccctcgacgtcgaccgacgtggcgccgggtcgtaccgg

SEQ ID NO: 281289 - DNA, 533 bp, Homo sapiens
  misc_feature: GYAE6OF02HI1XZ.38.38.D05.1.454.CMB.1.raw
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
  modified_base (464)..(464): a, c, t, g, unknown or other
  misc_feature (464)..(464): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctggtaccaacaacaccaggcaaacgccccaaactcatcatttatgacgtcactcatcggccctcaggggtttctactcgcttctctggctcagttgcaacncgcctccngaccattctggctcaggctgagcgagctagtaattttntgctcctcatatacaggcagcagcctacccttatcgtcttcggaactcggaaccacggtcaccgtcctacgtcacgcccaacggcccaaccccntcgtcactcgtccgttccccaccctcctaccgtacgtcgtactccgtacgtcgtacggccgggtaccgg

SEQ ID NO: 281290 - DNA, 533 bp, Homo sapiens
  misc_feature: GYAE6OF02GVRAR.38.38.D05.1.454.CMB.1.raw
  modified_base (351)..(351): a, c, t, g, unknown or other
  misc_feature (351)..(351): n is a, c, g, or t
  modified_base (496)..(496): a, c, t, g, unknown or other
  misc_feature (496)..(496): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattgggtggttataactatgtctcctggtaccaacaacacccaggcaaacgccccaaactcatcatttatgacgtcactcatcggccctcagggggtttctactcgcttctctggctccaagtttggcaacacggcctcctgaccatttcngggctccaggctgaggacgaggctagtaattttattgctcctcatatacaggcagcagccacccttatgtcttcggaactgggaccaaggtccaccgtcctacgcagcccaaggcccaacccactcgtcactccgtcgttccccnccctcctccacgtcgactccgactcgacggcgggtcg

SEQ ID NO: 281291 - DNA, 512 bp, Homo sapiens
  misc_feature: GYAE6OF02G50UN.38.38.D05.1.454.CMB.1.raw
  modified_base (268)..(268): a, c, t, g, unknown or other
  misc_feature (268)..(268): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (459)..(459): a, c, t, g, unknown or other
  misc_feature (459)..(459): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggccctcaggggtttctactcgcttctctggctcaagttgcacacgcctcctnacattcnggctcagctgagacgngctgtattttatgctctcatatacaggcacgcagccacccttatcgttcttcggaacgtgggaccaagtccaccgtcctacgtcacgcccaagcccaacccnctcgtccactccgtcttcccaccctcctcacgtcgactcgactcggagcggcg

SEQ ID NO: 281292 - DNA, 450 bp, Homo sapiens
  misc_feature: GYAE6OF02F2T0R.38.38.D05.1.454.CMB.1.raw
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggactggaccaaggtcaccgtcctacgtcacgcccaaggcccaaccccactcgtcactctcgttccccgcccctcctcacgtgactcgactgagcggctggcaggcnangn

SEQ ID NO: 281293 - DNA, 565 bp, Homo sapiens
  misc_feature: GYAE6OF02GDDUW.38.38.D05.1.454.CMB.1.raw
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctcaagttgcaacncgctccngacctattcnggctcagctgaggacgaggctgtaattttntgtctcctcatatacaggtcagcagcctacccttatcgtcttacggactcggaccaggttccaccgttcctacgtcgacgacccgaacggacccaacccactcgtacctacctccgttccgttacccccacccttccctaccgtaacccgtacgttcccggtaacgttacggacggtaccgggctacgggg

SEQ ID NO: 281294 - DNA, 369 bp, Homo sapiens
  misc_feature: GYAE6OF02JX1FO.38.38.D05.1.454.CMB.1.raw
  modified_base (320)..(320): a, c, t, g, unknown or other
  misc_feature (320)..(320): n is a, c, g, or t
  modified_base (322)..(324): a, c, t, g, unknown or other
  misc_feature (322)..(324): n is a, c, g, or t
  modified_base (326)..(369): a, c, t, g, unknown or other
  misc_feature (326)..(369): n is a, c, g, or t
tcagtcgatcacgtcacgaccggtgctcgatttagtatctgataggttgggtttctactcgcttctctggctccaagtttggcaacacggcctccctgacccatttctgggctccagggctgaggacgaggctgaattttattgctcctcatatacaggcagacagccaccccttatgtccttcggaactgggaccaaggtccaccgtcctacgtcgagacccaaggcccaaccccactcgtcctaacctccgtcggttccccgaccctccgtacacgtgacttccggactgagtcggtctggccaaggcacaagtagancnnngnnnnnnnnnnnnnnnnnnnnnnnnnnnnnnnnnnnnnnnnnnnn

SEQ ID NO: 281295 - DNA, 468 bp, Homo sapiens
  misc_feature: GYAE6OF02I9QCX.38.38.D05.1.454.CMB.1.raw
  modified_base (267)..(267): a, c, t, g, unknown or other
  misc_feature (267)..(267): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
  modified_base (459)..(468): a, c, t, g, unknown or other
  misc_feature (459)..(468): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttcngggctccaggctgaggacgaggctgaattttatgctcctcatatacaggcagcagccaccccttatgtcttcggaactggaccaaggtcaccgtcctacgtcagcccaaggcccaaccccatcgtcactctcgttccccaccctctcacgtnactcgactggacgtcgggctcggacaacgggcgcatgncnnnnnnnnnn

SEQ ID NO: 281296 - DNA, 546 bp, Homo sapiens
  misc_feature: GYAE6OF02GHIFY.38.38.D05.1.454.CMB.1.raw
  modified_base (216)..(216): a, c, t, g, unknown or other
  misc_feature (216)..(216): n is a, c, g, or t
  modified_base (329)..(329): a, c, t, g, unknown or other
  misc_feature (329)..(329): n is a, c, g, or t
  modified_base (393)..(393): a, c, t, g, unknown or other
  misc_feature (393)..(393): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactntgtctcctggtaccaacaacacccaggcaaacgccccaaactcatcatttatgacgtcactcatcggccctcgaggggtttctactcgcttctctgctccaagtttggcaacncggcctcctgacctatttcgtgggctccgaggctggagacgaggctagtaattttatgctcctnatatacaggcagcacgcctaacccttatcgttcttacggaacgtcgggaacctacggtccaccgtcctacgtcacgacccaacggcccaacccnctcgtcactccgtcgttccccnccctcctacacgtcgactccgactcggacgcggtacg

SEQ ID NO: 281297 - DNA, 304 bp, Homo sapiens
  misc_feature: GYAE6OF02G8ACX.38.38.D05.1.454.CMB.1.raw
  modified_base (295)..(304): a, c, t, g, unknown or other
  misc_feature (295)..(304): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttccccaccctcctcacgtgatcgactgagcggctggcaaggcgcatagnnnnnnnnnn

SEQ ID NO: 281298 - DNA, 591 bp, Homo sapiens
  misc_feature: GYAE6OF02FZ93I.38.38.D05.1.454.CMB.1.raw
  modified_base (436)..(436): a, c, t, g, unknown or other
  misc_feature (436)..(436): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctgtaccaacaacacccaggacaaacgccccaaactcatcatttatgacgtcactcatcgccctcgtaggggtttctactcgcttctctggctccagtttcgcacaccggcctcctcgacctattcgtcgggcctccgaggcgtggaggacgaggcttagtaactttttagtcgtcctcctcattactacgaggcacgcacgcctaaccccttntcgttcgttacggaacgtcgggacctaacggtccaccgttcctacgtccacgacccgaacggcccaaccccgactccgtacctactccgttccgttacccctacccctccctaccgtaccgtccgtacgtccgtacgtcggaccggcgggtaccg

SEQ ID NO: 281299 - DNA, 477 bp, Homo sapiens
  misc_feature: GYAE6OF02HTWEL.38.38.D05.1.454.CMB.1.raw
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
  modified_base (454)..(477): a, c, t, g, unknown or other
  misc_feature (454)..(477): n is a, c, g, or t
tcagtcgatcacgtcacgaccggtgctcgatttagtatctgatagttgggtttgggggcttcgtctgggtctcctggacagtccgatcaccatctcctgcactggaagcagtagtgacatttggtggttataactatgtctcctggtaccaacaacacccaggcaaagcccccaaactcatcatttatgacgtcactcatcggccctcaggggtttctactcgcttctctggctccaagtttggcaacacggcctcctgaccatttctgggctccaggctgaggacgaggctgaattttatgctcctcatatacaggcagcagcaccccttangtcttcggaactggaccaaggtcaccgtcctacgtcacgcccaagcccaaacccnctgtccactctcgttcccacccttcctcacgtgactcgactgacgcggctcggcaagcgcattagnnnnnnnnnnnnnnnnnnnnnnnn

SEQ ID NO: 281300 - DNA, 525 bp, Homo sapiens
  misc_feature: GYAE6OF02HBZY8.38.38.D05.1.454.CMB.1.raw
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcatcatttatgacgtcactcatccggccctcgaggggtttctactcgcttctctgctcaagtttgcaacncggcctcctgaccatttcngggctcgaggctgaggacgagctgtaattttnttgctcctcatatacgaggcagcacgcctacccttatcgtcttcggaactcgggaccaggtccaccgtcctacgtcacgcccaacgcccaacccnctcgtcnctctcgttcccnccctcctcacgtcgactccgactgcggcggcg

SEQ ID NO: 281301 - DNA, 547 bp, Homo sapiens
  misc_feature: GYAE6OF02HJ1LA.38.38.D05.1.454.CMB.1.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (387)..(387): a, c, t, g, unknown or other
  misc_feature (387)..(387): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaatcatcatttangacgtcactcatcggccctnaggggtttctactcgtcttctctggctcaagtttgcaacacgcctcctgaccattctgggctccgagctgagacgaggctagtaatttttattgctcctnatatacgagcagcagccacccttatgtcttcggactggacctagtcaccgtcctacgtcacgcccgaacgcccaacccactcgtacctacttccgtccgttaccccgcccttacccgtccgtaccgtcgtacgtccgtaccttcggacgtcgggtaccgg

SEQ ID NO: 281302 - DNA, 539 bp, Homo sapiens
  misc_feature: GYAE6OF02F1RTU.38.38.D05.1.454.CMB.1.raw
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcgaggggtttctactcgcttctctgctcagttgcacncgctccngacnttctggctcagctgaggcgagctgtaattttntgtctctcatatacaggcagcacgcctacccttatgttccgttacggaacgtcgggacctaaggtccaccgtccgtacgtcgacgcccaacggcccaacccgctcgtcactcctccgttccccgtccctcctacgtaccgtacgtactaccggtactcggacgccgggtcg

SEQ ID NO: 281303 - DNA, 486 bp, Homo sapiens
  misc_feature: GYAE6OF02IZBFL.38.38.D05.1.454.CMB.1.raw
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (463)..(486): a, c, t, g, unknown or other
  misc_feature (463)..(486): n is a, c, g, or t
tcagtcgatcacgtcacgaccggtgctcgatttagtatctgatagttgggtttgggggcttcgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggccaacacggcctccctgaccatttctgggcctccaggctgaggacgaggctgaattttatgctcctnatatacnggcagcagcctaccccttatgtcttcggaactggaccaaggtcaccgtcctacgtcagcccaaggcccaaccccactcgtcactctcgttccccgccctcctcacgtgactccgactgagcgggctgggacaagggccanatagncnnnnnnnnnnnnnnnnnnnnnnnn

SEQ ID NO: 281304 - DNA, 551 bp, Homo sapiens
  misc_feature: GYAE6OF02F78W1.38.38.D05.1.454.CMB.1.raw
  modified_base (491)..(491): a, c, t, g, unknown or other
  misc_feature (491)..(491): n is a, c, g, or t
  modified_base (539)..(539): a, c, t, g, unknown or other
  misc_feature (539)..(539): n is a, c, g, or t
tcagtcgatcacgtcacgaccggtgctcgatttagtatctgatagttgggtttgggggctttgcctgggctctgctgctcctcaccctcctcactcaggtcacagggtcctgggcccagtctgccctgactcagcctgcctccgtgtctgggtctcctggacagtcgatcaccatctcctgcactggaagcagtagtgacattggtgttataactatgtctctggtaccaacaacacccaggcaaacgccccaaatcatcatttatgacgtcactcatccggccctcgaggggtttcctactcgcttctctggctcaagtttgcaacacggcctcctcgacctatttcgtcgggctccgaggctggacggacgaggctagtaatttttagtcgtctcctcaattactacgagcagcagacctacccttatcgttcttacggactacgggaccaagtccaccgtccgtacgtcacgcccaacgcccaacccnctcgtcaccgtcttaccgtccctccctccgtcacgtcacgtccgacgnggtacgcggtcg

SEQ ID NO: 281305 - DNA, 549 bp, Homo sapiens
  misc_feature: GYAE6OF02GJXS9.38.38.D05.1.454.CMB.1.raw
  modified_base (268)..(268): a, c, t, g, unknown or other
  misc_feature (268)..(268): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaacgccccaaactcatcatttangacgtcactcatcgccctcgtaggggtttctactcgtcttctctgctcaagtttgcaacncgcctcctgacctattcncgggctccgaggctgaggacgaggtctagtaattttattgctcctcattagtacagcagcacgcctaccttatgtacttacggaactcggtaaccagtcacccgttcctacgtaccacgtacccaacggacccaacccagtcgacctacctcgttccgttccctccctccgtcaccggtcacgtcgacctggacggccggtcg

SEQ ID NO: 281306 - DNA, 591 bp, Homo sapiens
  misc_feature: GYAE6OF02F8RXQ.38.38.D05.1.454.CMB.1.raw
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattgggtgttataactntgtctcctggtaccaacaaccaccaggcaaacgccccaaactcatcatttangacgtcactcatcggccctcaggggtttctactcgtcttctctggctcagtttggcaacacggcctccctgacctatttcgtgggcctccgacggtctcggaaggacggaaggtccgtagtaatttttagttcgtacttcctctattactacgaggcacgtcacgtcctacccgttatcgttacgttccggtaacgtcgggaaccacggtccaccgttacctacgtccaccgtccgaacgacccacccactcgtacctacgtccgttccgtcccctcccttccctcgtaccgtcgtactaccgacgtcgacgtcggtaccgg

SEQ ID NO: 281307 - DNA, 569 bp, Homo sapiens
  misc_feature: GYAE6OF02ICKOC.38.38.D05.1.454.CMB.1.raw
  modified_base (532)..(532): a, c, t, g, unknown or other
  misc_feature (532)..(532): n is a, c, g, or t
  modified_base (562)..(562): a, c, t, g, unknown or other
  misc_feature (562)..(562): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttaataactatgtctcctggtaaccaacaacacccgaggaccaaacgccccaaactcaatcatttatgacgtcactcatccggccctgacggggtttctacttcgcttctctcggctcctaagtttgacaacacggcctcctgacctattttctgggctccaggtctaggaggacgaggcttagtaatttttagtcgtcttcctctataatacgaggcagacacgcctacccttatcgttcgttcggaacgtcgggaacctaacggtccaccgttcctacgtcacgaccaacggcccaacccgactcgtcacttcctcgttcccnccctcctacacgtcacgtccgacgtgacgnggtaccg

SEQ ID NO: 281308 - DNA, 597 bp, Homo sapiens
  misc_feature: GYAE6OF02FJLOV.38.38.D05.1.454.CMB.1.raw
  modified_base (238)..(238): a, c, t, g, unknown or other
  misc_feature (238)..(238): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacncccaggcaaagccccaaactcatcatttatgacgtcactcatcggccctcaggggtttctactcgcttctctggctccaagtttggcaacacggcctcctgacctatttctgggcctccaggctgaggacgaggctgtaattttatgctctcatatacaggcagcacgccaccccttatcgttcgttacggaacgttcggggacctaacgggttccaaccggttccctaccggttaccaccggtaccccaaacgggccccaaaccccgaccttacgttacccaccttccgttccggtttaccccctaccccttccctacctaccggttcgtacttaccgtaccgtggacggccgggtcg

SEQ ID NO: 281309 - DNA, 760 bp, Homo sapiens
  misc_feature: GYAE6OF02JI7EU.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggaccctcgacggggtttctactcgcttctctggctccaagttgcaacacggcctcctgacctattcgtgggccttccgacggtcctggaacgggtaccgaacggtcgttaggtaatttttacgttcggtccttcccttacgtaacttaacgttaacgtaacgggtacaacggtactaaccggtacctaaccccctttagttacgtttaccggttaccgggtaaaccgttcgggaaacccgtaacgggttaccctacccggtttacccgttaaccgtacgtaacccggaccccgaaacccgggtacccctaaacccccgtacgttaccgttacccgttaaccgtttcccggttaaccccggttttacccccggtaccccccgtttacccggtttaccccgtaacccgggttttaccggtaaccggtttaccccggtaacccgtttaccgggtaacccgggtcccgggggttacccggg

SEQ ID NO: 281310 - DNA, 545 bp, Homo sapiens
  misc_feature: GYAE6OF02HU10L.38.38.D05.1.454.CMB.1.raw
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
  modified_base (486)..(486): a, c, t, g, unknown or other
  misc_feature (486)..(486): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaaacaacaccaggcaaaacgccccaaactcatcattatgacgtcactcatcggccctcagggtttctactcgtcttctctcggctcctaagtttggcaaacacggccctcctgaaccagtttcngggtctccaggctaggacggacgaggctagtaaattttnttgctcctnatatacaggcagctagccaccttatntcttcgaactggaactaaggtccaaccgtcctacgcacgccaacggacccaaaccactnccacgttcctcgttcccgcctcccttccgagtcgacgtcgtaaactgacggcgggtacg

SEQ ID NO: 281311 - DNA, 531 bp, Homo sapiens
  misc_feature: GYAE6OF02IBP77.38.38.D05.1.454.CMB.1.raw
  modified_base (238)..(238): a, c, t, g, unknown or other
  misc_feature (238)..(238): n is a, c, g, or t
  modified_base (390)..(390): a, c, t, g, unknown or other
  misc_feature (390)..(390): n is a, c, g, or t
  modified_base (469)..(469): a, c, t, g, unknown or other
  misc_feature (469)..(469): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacncccaggcaaagcccccaaactcatcatttatgacgtcactcatcggccctcaggggtttctactcgcttctctggctcaagtttggcaacacggcctcctgacctatttctgggcctccaggctgaggacgaggctgtattttatgctcctnatatacaggcagcagcctacccttatcgtcttcggactggaccaggtcaccgtctacgtcacgccaacggcccaacccnctgtcactccgtcgttccccgccctcctccgtacgtcgacgttccgactcggacgcggtccg

SEQ ID NO: 281312 - DNA, 671 bp, Homo sapiens
  misc_feature: GYAE6OF02G2FZJ.38.38.D05.1.454.CMB.1.raw
  modified_base (322)..(322): a, c, t, g, unknown or other
  misc_feature (322)..(322): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttgggtaggttataactatgtctcctaggtaaccaaacaaccacccaggaccaaacgccccaaactcatctatttatgacgtcactcatccggccctcgtagggtttctacgtcgcttcncgtgcctctaagtttcggacaacgacggcctcctgacctattcgtcggctccgaggctggacggacgaggtctaggttaactttttagtcggtacctccgtactaattactacgtaggcacgcacgtacctacccttagtcgttacgtacggtaacgtcgggaaccaacggtaccacccgttccgtaacgtaccgacgtaccccgaaaccggacccctaaaccccgtacgttacgtacccttaccgttacccgttcccggttaccccccgtccccgttacccgttacccgtacggttaccggtacttacccgggtaccgttaccgggtaccgggaccggggttacccgg

SEQ ID NO: 281313 - DNA, 563 bp, Homo sapiens
  misc_feature: GYAE6OF02GMLNP.38.38.D05.1.454.CMB.1.raw
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaagccccaaactcatcatttatgacgtcactcatccggccctcgtaggggtttcctactcgcttctctcggctcaagtttgacaacacggcctcctgaccatttctgggctccgagctgacggacgaggctagtaattttatgctctcatatacgngcagcancctacccttatcgttcttcggaactgggaacctaggtccaccgtcctacgtcacgacccgaagacccaacccgcttcgtaccaccttcgttccggttccccgcccttcccgtccgtaaccgttcgactccggtactacgggaccggtccggtcgg

SEQ ID NO: 281314 - DNA, 535 bp, Homo sapiens
  misc_feature: GYAE6OF02G0KEA.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaaactcatcatttatgacgtcactcatcggccctcaggggtttctactcgcttctctggctcagtttggacacacggcctcctgaccattcgtgggctccaggtctgaggacgaggctagtaatttttatgtctcctcataatacaggcagcagccacccttatcgtcttcgacgtcggacaacggtcaccgtctacgtcacgacccaacggcccaacccatcgtccacttcgtccgttccccgccctcctccacgtcgactccgactgacggcggtacgg

SEQ ID NO: 281315 - DNA, 474 bp, Homo sapiens
  misc_feature: GYAE6OF02FKDQ6.38.38.D05.1.454.CMB.1.raw
  modified_base (307)..(307): a, c, t, g, unknown or other
  misc_feature (307)..(307): n is a, c, g, or t
  modified_base (405)..(405): a, c, t, g, unknown or other
  misc_feature (405)..(405): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (454)..(474): a, c, t, g, unknown or other
  misc_feature (454)..(474): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacaccggcctccctgaccatttctgggctccaggctgaggacgaggctgattttatgctcctnatatacaggcagcagccaccccttatcgtcttcggactggaccaaggtcaccgtcctacgtcacgcccaagcccaaccccatcgtcactctcgtcccncctcctcacgtcatcgactgacgcggactggcaaggcgacngtagncgnnnnnnnnnnnnnnnnnnnnn

SEQ ID NO: 281316 - DNA, 551 bp, Homo sapiens
  misc_feature: GYAE6OF02FPXXC.38.38.D05.1.454.CMB.1.raw
  modified_base (329)..(329): a, c, t, g, unknown or other
  misc_feature (329)..(329): n is a, c, g, or t
  modified_base (547)..(547): a, c, t, g, unknown or other
  misc_feature (547)..(547): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctcaagtttggcaacncggcctccctgacctatttcgtgggcctccgaggctggaggacgaggctgtaattttatgctctcatatacagcagcacgcctacccttatcgttcttacggaacgtcgggaaccgtaacggtccaccgttccctacgtcacgacccgaacggacccaacccactcgtccactccgtcgttccccgccctccgtacgtgactcgactggacggcggtntcgg

SEQ ID NO: 281317 - DNA, 620 bp, Homo sapiens
  misc_feature: GYAE6OF02I5IDH.38.38.D05.1.454.CMB.1.raw
  modified_base (193)..(193): a, c, t, g, unknown or other
  misc_feature (193)..(193): n is a, c, g, or t
  modified_base (575)..(575): a, c, t, g, unknown or other
  misc_feature (575)..(575): n is a, c, g, or t
tcagtcgatcacgtcacgaccggtgctcgatttagtatctgatagttgggtttgggggcgtttgcctgggctctgctgctcctcaccctcctcactcagggcacagggtcctgggcccagtctgccctgactcagcctgcctccgtgtctggggtctcctggacaggtcgatcaccatctcctgcactggaancagtagtgacattggtgttataactatgtctctggtaaccaacaacacccgaggacaaacgaccccaaactcactactattatgacgtcactcatccgaccttcgacggggtttctactcgtcttctctcggccttccgtaaagtttcgggactaaccgacggtccctacccgtgtaacctattccggtcgggccttacccgaggtactaggacggtacgcgggtacttaggtaatttttagtcgtaccgttacctatatagtacgtaggacacgtcgacgcctaaccttatcgtacgtcgtaacgtacggaccgtacgtccgaccgtactacgtcacgaccacgaccctaaccacgttacgactacgtcgttccgtacccncccgtcctaccgtacgtacgtcgactaccgtacggcgcggtacgg

SEQ ID NO: 281318 - DNA, 666 bp, Homo sapiens
  misc_feature: GYAE6OF02JMMZU.38.38.D05.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
tcagtcgatcacgtcacgaccggtgctcgatttagtatctgatagttgggtttgggggtcgtttgcctgggctctgctgctcctcaccctcctcactcagggcacagggtcctgggcccagtctgccctgactcagcctgcctccgtgtctgggtctcctggacagtcgatcacatctctgcactggaancagtagtgacattggtgttaanaactatgtctctggtaccaacaccaccgaggcctaaaacgccccaaactcaatcattatgacgtcactcatcgcctcagggtttcactcncttctctgctacagttgcacacgcctctcgaccattcgtggctcgacggctgacgacgagcgtagtaattttatcggtacttccgtactattactacgacgactagcctaacgccctaaccccgtttgtaccggttacgttaccggtaacgttacgggaacccggtaaacgggttcccgttaaaccccggttcccgtttaaccggtacccgtaaccggttacccccgaaaccgggtaaacccctaacccccgtacttaccgggttaccctaacccgtttcccgttaacccgttccccttaccccggttccctacccgttacgtaccgtaccgttccgaaccgtttccgacgggtccggtaccgg

SEQ ID NO: 281319 - DNA, 558 bp, Homo sapiens
  misc_feature: GYAE6OF02JCXC8.38.38.D05.1.454.CMB.1.raw
tcagtcgatcacgtcacgaccggtgctcgatttagtatctgatagttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctctagtttggcaacgacggcctccctgacctatttcgtgggctccgaggctgaggacgaggctagtaattttatgctcctcatatacaggcagcagcctacccttatcgtcttacggacgtggaccagtccaccgtctacgtcacgcccgaacggcccaaccctactcgtacctactccgttcgttacctccctacccttccctacgtaccgtacgtacgtaccgtacgtacggcggtaccggg

SEQ ID NO: 281320 - DNA, 556 bp, Homo sapiens
  misc_feature: GYAE6OF02JBQLJ.38.38.D05.1.454.CMB.1.raw
  modified_base (219)..(219): a, c, t, g, unknown or other
  misc_feature (219)..(219): n is a, c, g, or t
  modified_base (406)..(406): a, c, t, g, unknown or other
  misc_feature (406)..(406): n is a, c, g, or t
  modified_base (485)..(485): a, c, t, g, unknown or other
  misc_feature (485)..(485): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgacagtttggtgttataactntgtctcgtagtaccaacacaccgagacaaacgccccaaatcatcattatgacgtcactcatcggcctcgtagggttctacgtcgcttcgtctgctctaagttcgacacacggcctcctgactattcgtggctacgagtcgtgagacgagtctagtaattttgtgtactctacaattactacacggtnacgtcagtcctacccttagtcgtacgtacgacgtcggaacacggtccaccgtcctacgacacgaccaacgaccaacctntacgtactaccgtcgtaccgtccccgtcctccgtaccgtacgtacgtactcgacgtcggaccgtcggtacg

SEQ ID NO: 281321 - DNA, 570 bp, Homo sapiens
  misc_feature: GYAE6OF02H6AAZ.38.38.D05.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (501)..(501): a, c, t, g, unknown or other
  misc_feature (501)..(501): n is a, c, g, or t
tcagtcgatcacgtcacgaccggtgctcgatttagtatctgatagttgggggtttgggggctttggcctgggctctgctgctcctcgaccctcctcactcagggcacgacgggtcctgggcccagtcctgccctgtactcagcctggcctccgtgtctcgggtctcctggacagtcgaatcacactctcctgcactggacncagtaagtcacattggtcgttataactntgtctctgtaccaanaccaaccaggcaaagcccctaaagtcatcattatcgacgtcactcatccgcctnagggttctacgtcgcttcnctggcctcaagttcggcaaccncggcctctgtaccattcgcgggcctcgnggtcnggacgacgnggcctagtaattttcngtcctccgtcgatagtacgagacagcacgtctacccttatcgttcgttacggaacgtcggaacaacggtctaccgtcgtacacgacgacccgaagcccgaaccncgtacgtactacgtccgttcgttccccgtccctcctacgacgtctctaccggtctcggacgtcggtccg

SEQ ID NO: 281322 - DNA, 745 bp, Homo sapiens
  misc_feature: GYAE6OF02I0770.38.38.D05.1.454.CMB.1.raw
  modified_base (275)..(275): a, c, t, g, unknown or other
  misc_feature (275)..(275): n is a, c, g, or t
tcagtcgatcacgtcacgaccggtgctcgatttagtatctgatagttgggttgggggctttgcctgggctctgctgctcctcaccctcctcactcagggcacagggtcctgggcccagtctgccctgactcagcctgcctcagtgtctgggtctcctggacagtcgatcaccatctcctgcactggaagcagtagtgacattggtaggttataactatgtctcctggtaccaacaacacccaggacaaacgacccccaaactcactactatttangaccgtcactcacgtcggccctacgtacgggtttctacttcgtcttctctcggtcctacgtaagtttcggaccaacgaccggtcccttccgtcgtaccctattttccgtcggtccttcccgaggtcgtacggaggtacggacggtcgttaggttaacttttagtacgtccttaccctactaagttaactacgtaggtaccgaacggtaccgaccgtacccgttaacccttttaggttaccgtttaccggtttaaccgggtaacccggttacgggaaacccgttaaccgggttaccctaacccgggtttacccgtaaccggttacccgaaccggtaacccccggtaaccggaaccccctaaaccccgtaccgttacgttacccgtaccgtttcccgttacccgttaccccgtacccttacccgtaccgttaccgtacgtacgtacccggtacgttaccggacggtcccggg

SEQ ID NO: 281323 - DNA, 551 bp, Homo sapiens
  misc_feature: GYAE6OF02FUHBG.38.38.D05.1.454.CMB.1.raw
  modified_base (190)..(190): a, c, t, g, unknown or other
  misc_feature (190)..(190): n is a, c, g, or t
  modified_base (402)..(402): a, c, t, g, unknown or other
  misc_feature (402)..(402): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtggttataactatgtctcctggtaccaacaacacccaggcaaacgccccaaactcatcatttatgacgtcactcatcggccctcaggggtttctactcgcttctctggctccaagtttggcaacacggcctccctgacctatttctgggctccgaggctggaggacgaggctgtaattttatgctcctctatatacnggcagcagcctacccttatcgttcttcggaacgtcggaccaaggtccaccgtcctacgtacacgacccaacggacccaacccactcgtcactcctccgttcccctacccgtccctacacgttcacgttccgactacggcgtcgggtccg

SEQ ID NO: 281324 - DNA, 630 bp, Homo sapiens
  misc_feature: GYAE6OF02HLWN3.38.38.D05.1.454.CMB.1.raw
  modified_base (279)..(279): a, c, t, g, unknown or other
  misc_feature (279)..(279): n is a, c, g, or t
tcagtcgatcacgtcacgaccggtgctcgatttagtatctgatagttggggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattgggtggttataactatgttcctcctggtaacccaaacaacacccgtaggccaaacgccccaaaatcatcattangacgtcactcatcggccctcgagggtttcacgtcgcttctctcggctcgaagttgacacaccggtcctccctgacctatttcgtgggtcctccgagctggagacgaggtcctgtaaacttttgttcgccttccgtactataactacgaggcctagtactacgaccctaccccgttaattcgttaccgttacgggaaccttacgggaaccttacgggtcctaaccggttccctaacgtaccgaccgacccgaaacggaccccaaccgtacgtccgtactacccttcgttccgttcccccacccttcccgcgtaaccgttcgtactcccgacggtacgacgtccgggtaccgg

SEQ ID NO: 281325 - DNA, 723 bp, Homo sapiens
  misc_feature: GYAE6OF02G4E0W.38.38.D05.1.454.CMB.1.raw
tcagtcgatcacgtcacgaccggtgctcgatttagtatctgatagttggggtttgggggctttgcctgggctctgcctgcctcctcaccctcctctactctaggggcacagggtcctgggcccagtctgcctgactcagcctgccttccggtgtcgtgggtcttccgttggtactaggttcgtaatcgacctatctcctgcacgtggaagctaggtagtgactaggttggtgttataactatgtctccgtcggtaaccaacacaccaggcaaacgccccaaatcatcatttatcgtacgtcactcatccgacctgaggggtttctacgtcgcttctctcggcgtacgtaagtttggacaacgcggcctacctgaacctattccgtacggtctaccgaggtcgtaggtaacgggacggtacggtaccttagggtttaaacgttttttagtacgggtaccttcccgtaaccgtaatttaacgtacggtaacggacctaggtaccgaacgttaccctaaaccccgttagttccgttaaccgttacggaacgttacgggaacctaaggttaccgtacccgttacgtaaccgttccgaaccgaacccgtaaaccgggaccccaaacccgaccgttacgttacctaaccgtttccgtaccggttacccctaacccgtccgttacggaccgttaggtaccttacggaccgtaggtaccgggcggtaccgg

SEQ ID NO: 281326 - DNA, 581 bp, Homo sapiens
  misc_feature: GYAE6OF02FVE5F.38.38.D05.1.454.CMB.1.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagtcgatcacgtcacgaccggtgctcgatttagtatctgatagttgggtttgggggcgtttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctggtacaacaacnccaggcaaacgccccaactcatcattatanacgtcactcatcggccctcgaggggtttcacgtcgcttcnctgctccaagtttgcaacacggcctcctagacctatttctgggccttccaggctggacggacgnggctagtaattttntcgtctcctnatactacagtacagacacgcctacccttatcgttcgttaccggaagtcgggacctaaacggtccgaaccgttccgtacgtacacgtacccaacggtacccaaccccgtactcggtccaacgtcgttccggtcccccgccttccctacgaaccgtctaacgttccgaacgtcgtaggccggtaccgg

SEQ ID NO: 281327 - DNA, 587 bp, Homo sapiens
  misc_feature: GYAE6OF02JDRC1.38.38.D05.1.454.CMB.1.raw
  modified_base (558)..(558): a, c, t, g, unknown or other
  misc_feature (558)..(558): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtggttataactatgtctctggtaccaacaacaccaggacaaacgccccaaatcatctatttatgacgtcactcatcgccctagagggtttctactcgtcttctctcggcctacgtaagttcggacaacgaccggtccctaccgtacgtacctactttcgtcgggcctaccgaggtcgtggtcgggaacgtacggtacttacgttaaagtttttcgtacgtccgtaccttacaattaactacgacggtcacgcgtacgcctacccttagtcgtacgttacgaacgtacggaccagtccacgtccgacgtaccgacgtaccgaacgccaaccctatcgtacactctccgtcccnctcctcgactgactcacgtgacgcggtcg

SEQ ID NO: 281328 - DNA, 540 bp, Homo sapiens
  misc_feature: GYAE6OF02H6XAX.38.38.D05.1.454.CMB.1.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaatcatcatttatgacgtcactcatcggccctnaggggttttcactcgcttctctggctccaagtttggcaacacggcctccctgaccatttctgggctccaggctgnggacaggctgaatttttatgctcctnatatacaggtcagcagcaaccccttatcgtcttcggaactgggacctaaggtccaccgtcctacgtcacgacccaacggcccaaaccccactcgccaccttcgtcgttaccccgccctcccgttcacgttcgactccgactgacggcggtcg

SEQ ID NO: 281329 - DNA, 551 bp, Homo sapiens
  misc_feature: GYAE6OF02FIDE8.38.38.D05.1.454.CMB.1.raw
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (511)..(511): a, c, t, g, unknown or other
  misc_feature (511)..(511): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactntgtctcctggtaccaacaacacccaggacaaacgccccaaactcatcatttangacgtcactcatccggccctcgaggggtttctactcgcttctctggctccaagtttggcaacgacggcctccctgacctatttcgtgggcctccgaggctggaggacgaggctagtaattttatgtctcctcatagtacnggtcagcacgcacccttntcgttcttacggaactcgggacctaacggcaccgtcctacgtcacgccaacggcccaacccactcgtacactcgtcgttccccncccttcctacgaccgttcgactccgactggacgcggtacg

SEQ ID NO: 281330 - DNA, 806 bp, Homo sapiens
  misc_feature: GYAE6OF02IUI61.38.38.D05.1.454.CMB.1.raw
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
  modified_base (371)..(371): a, c, t, g, unknown or other
  misc_feature (371)..(371): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattgggtgttaataacgtatcgtcttcctaggtaccaacaaccacccgaggaccaaaacgccccaaactcatcatttangacgtcactcatccggtccctacgtagggttctactcgtcttcncgtggctaccgtaagttcggacaacgaccggcctccgtacgaacctntttcgtcgggtcctaccgacggtcgtacggaacgggtaccgtacggtacttaaggtttaaacttttttacgttccgtacctttcccttaactaacgttaacttaaccggtaagggtaccaacggtaccaaaccggtacccctaaaccccgttttgttaccgggtttacccggtttaacgggttaaaccccgggtacggggttaaacccgtaaaacgggtttcccgtaaccccggtttacccgtaaccggtacccgtaaccgggacccccgggtaaaaccccgggccccctaaaaacccccgttccgttaccggttaccctaacccggtttacccggttcccgttacccccccggtcccttaccccgtttaaccggtacccgttagggttaaccctccggtaacgttaccgggtaccgggtcccggggttacccgg

SEQ ID NO: 281331 - DNA, 553 bp, Homo sapiens
  misc_feature: GYAE6OF02GECRK.38.38.D05.1.454.CMB.1.raw
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacacacccaggcaaacgccccaaactcatcatttatgacgtcactcatcggccctcgtacggggtttctacgtcgcttctctggctctagtttgcacacggcctcctgacctattctcgggctccgaggctggaggacgaggtctagtaattttntgtctctntatactacaggcagcacgcctacccttatcgtcgttacggaactcgggaacctacgtccaccgtcctacgcacgacccgaacgacccaacccgtactcgtcactcctcgtccccgtccctccgtcgacgttcgtactccgacgtcgtacggcggtacg

SEQ ID NO: 281332 - DNA, 899 bp, Homo sapiens
  misc_feature: GYAE6OF02IZC3C.38.38.D05.1.454.CMB.1.raw
  modified_base (171)..(171): a, c, t, g, unknown or other
  misc_feature (171)..(171): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
tcagtcgatcacgtcacgaccggtgctcgatttagtatctgatagttgggtttgggggctttgcctgggctctgctgctcctcaccctcctcactcagggcacgagggtccgtgggcccagtctcgccctgacctcagcctgccctcgtcgtcgtgggtcctccgtggacngtcgatcaccatcctcctgcacgtggaacnctagtgtagactagtttgggtagtttaataaacttntcgttccttaccgtacggtaaccaacaaccaccgaggaccaaaaccgccccaaactcactactattactacgacgtcctaactcacgtccgtcccgtacggtacggggtttacctacgtcgttccttccgtacgtcggacccttaccgttaaacggtttcggaacctaaccggtacccggtacccttcccgtacgtaacccttacgtttccggtcggggaccttacccggaggtcgtacggaacgggtacggtacggtcgttaaacggtttaactttttacgttccgtccttacccttaataacttaaccgttaacggtaaccgggaccgtaacgtaaccgtaacccggtaccccttaacccgttttagtttacccggtttaccggttaaccccgggttaaacggttaccggggaaacccgttaaacgggttaccccgttaaccccgggttaacccgtttaaccccggaaccgttaacccggaacccccggtaaacccggtaaacccccgtaaccccccgttaagttcccggtaaccccttaacccgtttccccggtttaccccggttaacccccctacccccgttacccgtttaaccgaacccgttacggtaccccggttacggtacccggtcggggtaacccggtcccgggttacccggg

SEQ ID NO: 281333 - DNA, 613 bp, Homo sapiens
  misc_feature: GYAE6OF02JISB9.38.38.D05.1.454.CMB.1.raw
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
  modified_base (528)..(528): a, c, t, g, unknown or other
  misc_feature (528)..(528): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttataaactatgtcctcctggtaccaacaaccacccaggcaaaagcccccaaatcatcatttangacgtcactcatccggccctcgaggggtttctactcgtcttctctggctccgaagtttggacaacncggcctcctgacctatttcgngggctccgaggctggaggacgaggctagtaattttactgccttcctactatactacgacggtcacggtcacggccttacccttattcgttacgttacggaacgttcgggaaccgaaggtccctaccgttacctacgtaccgacgtcccgaacggtacccaaccccgtnttacgtccttacctcgttcccgttccccgtccctcccgtacgtacggttacgaccttccggtaacgtcggacggtccgggtaccg

SEQ ID NO: 281334 - DNA, 539 bp, Homo sapiens
  misc_feature: GYAE6OF02FQ2GC.38.38.D05.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccatttcnggctccaggctgacggacgaggctgtaattttatgctctcatatacaggcagcacgccacccttatcgttcttcggactcgggaccaaggttccaccgtcctacgtcgacgacccaacggcccaaccctcgtcgtccacgtcgttccgtcccgccctcctccacggtcacgtcgacgtggacgcgggtcg

SEQ ID NO: 281335 - DNA, 633 bp, Homo sapiens
  misc_feature: GYAE6OF02H96CT.38.38.D05.1.454.CMB.1.raw
  modified_base (190)..(190): a, c, t, g, unknown or other
  misc_feature (190)..(190): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacatttgggtggttaataactatgtctcctggtaccaacaacacccaggccaaaacgccccaaactcatcattatgacgtcactcatcgccctnagggtttctactcgcttctctgctccaagtttgactaacacgcctcctgacctattttcncgggctccaggtctacgacggacgacggcgtagtaattttttcgttgtccttctacgaagttaactaacgacggtaccaaggacaacggtcctaacccctttaatcgttacgttacggaacgttcggggaacctaaggtacctaaccgttcctacgtccaccgtacccaaccggacccaaccccatcgtaccaaccttccgtaccggttccccctcccgtccctttaccgaccggttacaccgttacccggtaccgttacggacccgggtcgggtacccgg

SEQ ID NO: 281336 - DNA, 599 bp, Homo sapiens
  misc_feature: GYAE6OF02I6HP4.38.38.D05.1.454.CMB.1.raw
  modified_base (327)..(327): a, c, t, g, unknown or other
  misc_feature (327)..(327): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaacgccccaaactcatcatttatgacgtcactcatccggccctcgtaggggtttctactcgtcttctctgctcagttgcacncgcctcctcgactattcgtggctccgagtcgtggacggacggacggtcgtagttaactttttacttcgtcctcctactaatactacgaggcacgcacgcctacccgtttatcgttacgttcggaacgtcggaaccgaacggttccgtacccgtccgtacgtccgacgacccgaaacggacccctaacccgattaccgtacctaccttccgttaccttcccctacccgtcctacgccgttacgtctaccggtacgtacggaggtccgggtacg

SEQ ID NO: 281337 - DNA, 616 bp, Homo sapiens
  misc_feature: GYAE6OF02HIAZ1.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtggttataactatcgtctcctggtaccaacaacacccaggcaaacgccccaaactcatcatttatgacgtcactcatccggccctcgacgggtttctactcgtcttctcgtcggctccgtaagtttcggacaaccgaccggtccctccctcgtaccctacgtttctgggcctccgaggctggacgacgaggcttagtaatttttagttcgccttcctctatactaacgaggcagcagtccctacccttagttcgttccgtacgaacgtcggaaccgtaaggtcctacccgttaccgtaccgtctacgacccgaaccggacccaacccacttcgtaccaccttccgttaccgttccccgcccttccgtcctaccgtcgtaccgtcgtaccggtaggtaccggcggtaccgg

SEQ ID NO: 281338 - DNA, 533 bp, Homo sapiens
  misc_feature: GYAE6OF02GSZP5.38.38.D05.1.454.CMB.1.raw
  modified_base (351)..(351): a, c, t, g, unknown or other
  misc_feature (351)..(351): n is a, c, g, or t
  modified_base (481)..(481): a, c, t, g, unknown or other
  misc_feature (481)..(481): n is a, c, g, or t
  modified_base (501)..(501): a, c, t, g, unknown or other
  misc_feature (501)..(501): n is a, c, g, or t
  modified_base (515)..(515): a, c, t, g, unknown or other
  misc_feature (515)..(515): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctccaagtttggacaacacggcctcctgacctattcgngggtcctccgaggctggacggacgaggctagtaattttatcgctcctcatatacagcagcacgctacccttatcgtctacggactcgggaccaggtccaccgtcctacgtcacgcccaaggcccaacccnctctctactcgtcgtccccnccctcctcacgtcnctcgactggacgcggtcg

SEQ ID NO: 281339 - DNA, 351 bp, Homo sapiens
  misc_feature: GYAE6OF02FGDAS.38.38.D05.1.454.CMB.1.raw
  modified_base (342)..(351): a, c, t, g, unknown or other
  misc_feature (342)..(351): n is a, c, g, or t
tcagtcgatcacgtcacgaccggtgctcgatttagtatctgatagttgggtttgggaacctatgaacattctgtaggggccactgtcttctccacggtgctcccttctactcgcttctctggctccaagtttggcaacacggcctccctgaccattctgggctccaggctgaggacgaggctgaattttattgctcctcatatacaggcagcagcaccccttatgtcttcggaactgggaccaaggtcaccgtcctacgtcagcccaaggcccaaccccactgtcactctgttccccgccctcctcacgtgatcgactgagcgggctggcaaggcgcatagnnnnnnnnnn

SEQ ID NO: 281340 - DNA, 619 bp, Homo sapiens
  misc_feature: GYAE6OF02F6Q23.38.38.D05.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttataactntgtctcctggtaaccaacaacacccgaaggcaaacgccccaaatcatcatttatgactcactcatccggcctctaggggtttctactcgcttctctggctcctaagtttggacaacacggtccctccctgaacctatttcgcgggtacttccgaggtcgtgaggacgaggccttaggtaacttttagttcgtacctccgtataactaattacgaggtcacgctacgccctaacccttgtcgttcgttccggaacgtcggaaccgaacggtccacccgttaccttacgccacgacccgaacgcccaaccctactagtcctaaccgttccttccggttaaccccgccccttacctaccgtaccgttagtaccgtaccggtaaccgtcggacggtacccggtccgg

SEQ ID NO: 281341 - DNA, 603 bp, Homo sapiens
  misc_feature: GYAE6OF02FLFX2.38.38.D05.1.454.CMB.1.raw
  modified_base (273)..(273): a, c, t, g, unknown or other
  misc_feature (273)..(273): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttataactatgtctcctagtaccaaacaacacccaggacaaacgccccaaactcaatcatttangacgtcactcatcggccctctaggggtttctactcgcttctctggctccaagttgcaacacggcctcctgacctattcgtcggctccgacgtctcggaggacgaggccgtagttaattttagttcgcttcctctaattactaacgaggtacacgactacgcctaaccctttagtcgtttacgttaccggaacgtcgggaacctacggtaccaccggtcctaccgtcaacgcccaaacggacccaaccccgtacgtctactactccgttccggttaccccgcccttcccgtacgtaccgtgtacgtccggaacttcggacggtcggaccgg

SEQ ID NO: 281342 - DNA, 648 bp, Homo sapiens
  misc_feature: GYAE6OF02GJ8Q7.38.38.D05.1.454.CMB.1.raw
  modified_base (219)..(219): a, c, t, g, unknown or other
  misc_feature (219)..(219): n is a, c, g, or t
  modified_base (298)..(298): a, c, t, g, unknown or other
  misc_feature (298)..(298): n is a, c, g, or t
tcagtcgatcacgtcacgaccggtgctcgatttagtatctgatagttgggtttgggggctttgcctgggctctgctgctcctcaccctcctcactcagggcactgggtcctgggcccagtctgccctgactcagcctgcctccgtgtctgggtctcctggacagtcgatcacatctctgcactggaagcagtagtgacagtttggtgtttaataaactntcgtctcctggtaaccaaacaacacccaggcaaaacgccccaaactcatcatttatgacgttcactcagtccggccctnaggggtttctacgttcgcttctctggctaccgaagttttcggcaacaccggtcctcctgacctatttcgtagggcctcacggtctagacggacgaggctagtatttttatgtcttctctatacttacgaggtctagacacgaccctaacccttatacgttcgttacggaacgtcggacctaacggtcctaaccgtcgtaacgttcgacgtacccaacggacccctaaaccccgacgttcggtacctaaccggtaccctttaccggttaccccctaaccccgttacccgttaccgtaaccgttaccggtacgttaacccgtaccggtaggacccgggtcggggtaacccgg

SEQ ID NO: 281343 - DNA, 696 bp, Homo sapiens
  misc_feature: GYAE6OF02HPG55.38.38.D05.1.454.CMB.1.raw
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcaagtagtgactagtttgggtggttaataactatgtctcctaggtaaccaacaacacccaggacaaaacgccccaaaactcatcaatttangacgtcactcatccggccctcgaggggtttctacgtcgcttctctggctcctaagttggacaacgacggcctccngacctattcngggtcctcgagctaggacggacgaggctgttaaatttttactcggtccttaccgttacaattaactaacgtaaggccaacgaccgaagtacccctaaccctttaagtccggttaccgtttacgggaaacgttacggggaaccctaaagggtaccttaaccccgtaccgtaaccggtcgaacccggtaaccccgaaacgggtaacccccaaaccccgttacgtccgtaccctaaccgtttccgttacccggtttccccccgacccttacccgttaccgtaaccggtacgtaaccgttccgaaccggtacggtacgggcccgggttaaccgg

SEQ ID NO: 281344 - DNA, 721 bp, Homo sapiens
  misc_feature: GYAE6OF02IDZQW.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagtttggtgttaataactatgtctcctggtaaccaaacaacacccaggaccaaaacgccccaaactcatcatttatgacgtcactcatccggccctcgagggtttctactcgtcttctcgtggctctaagtttcgactaacaccggtcctcctcgacctatttcgtcgggtcctccgaaggtctaggacggacgaggtcttagtaagtttttagttcgtcttcccttactaattactaccgaggtaccgacgaccgacggtaccctaaccccgtttagttccgttaccgtttaccgggtaaaccggtacggggtaacccgtaaacggttacccgtaaccccggtttaccgttacccggttaccaaccgggaaccccgaaaccgggaccccctaaaacccccgtaccgttaccgtacccgtaacccttccgtttcccggtttacccccggtccccttaccccgtacccgtaaccggttcgtaaccgttccggaaccgttcgggaccggccgggtacccggg

SEQ ID NO: 281345 - DNA, 465 bp, Homo sapiens
  misc_feature: GYAE6OF02GN03J.38.38.D05.1.454.CMB.1.raw
  modified_base (446)..(446): a, c, t, g, unknown or other
  misc_feature (446)..(446): n is a, c, g, or t
  modified_base (449)..(465): a, c, t, g, unknown or other
  misc_feature (449)..(465): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtcctacgtcacgcccaaggcccaaccccatcgtcactctcgttcccaccctcctcacgtgactcgactgagcggctggcagcgcanagnnnnnnnnnnnnnnnnn

SEQ ID NO: 281346 - DNA, 575 bp, Homo sapiens
  misc_feature: GYAE6OF02F7FRX.38.38.D05.1.454.CMB.1.raw
  modified_base (400)..(400): a, c, t, g, unknown or other
  misc_feature (400)..(400): n is a, c, g, or t
  modified_base (503)..(503): a, c, t, g, unknown or other
  misc_feature (503)..(503): n is a, c, g, or t
tcagtcgatcacgtcacgaccggtgctcgatttagtatctgatagttgggtttgggggctttgcctgggctctgctgctcctcaccctcctcactccagggcacagggtcctgggccccagtctgccctgactcagcctgcctccttgtctgggtctcctggacagtcgatcaccatctcctgcactggaagcagtagtgacattggtggttataactatgtctcctggtaccaacaacacccaggcaaacgcccccaaaactcatcatttatgacgtcactcatccggccctctaggggtttctactcgcttctctggctccaagtttggcaacgcgcctcctgacctattctgggcctccaggctaggaggacgaggctagtaattttatcgcttccnctaatatacaggcagcacgcctaccccttatcgttcgttaccggaacgtcgggaaccaggttccaccgttccgtacgtccacggacccaacggcccaaacccncgtcgtaccacgtcctccgttcccctaccccgtcctacctacgtctacgtccgacgtcggacggtcgggccg

SEQ ID NO: 281347 - DNA, 914 bp, Homo sapiens
  misc_feature: GYAE6OF02I58VH.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatccaccatctcctgcactggaagcagtagtgactattggtgttataactatgtctctaggtacccaacaaccacccaggacaaacgccccaaactcatcattatcgacgtcacctcatccggcccttacgtagggggttttaccttacgtcggtcctttccgtcgttaggccttccgtaaggttttacggaccaaccgaaccggggtccccttaccccgtcggtaacccttacgttttcccgtcggggtacccttacccgacggggtccgttacgggaaacggggaaccggggtaacgggtccgttacggtttaaaatttttttaaccggtttcggtacccttttaccccgttaccctttaaaacgtttaacgtttaaaccgggaaaccggggtacctaaaccgggtcccgtaaaccgggtacccccttaaacccccccgtttttaagtttccggtttacccggttttaaaccggggttaaacccgggtttaccgggggtaaaccccgttaaacggggtttacccctaaacccccggggttttaccctaaccccgggtttacccgaacccgggttaaacccccgaaacccgggtaccccctaaaacccccggtacccgtttaccggtaccctaacccgttcccgtttaacccgggttccccccggtacccccttccccgttaccgttacccggttacgtacccggtttaccggtaacccgtacggtacccgggtcccgggtacggg

SEQ ID NO: 281348 - DNA, 545 bp, Homo sapiens
  misc_feature: GYAE6OF02GMX4U.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcttggtaccaacatcaccaacatcacccaggcaaagtccccaaactcataatttatgaggtcactaaacggccctcaggtgtttctaatcgcttctctggctcaagtctgcaacacgcctcctgaccatctctggctccaactgaggcaggctcactatattgcagctcaatatacaagcagcgtcactttggggtcttcgggcgggaacgggaccgaccgttacggaccgttcttacgggtcacgacccgaaggcctccggcccccgtcggtccaccttccgtccgttcccacccttcccgtaccgacgtcgacgtcgtaacg

SEQ ID NO: 281349 - DNA, 609 bp, Homo sapiens
  misc_feature: GYAE6OF02JG6I2.38.38.D05.1.454.CMB.1.raw
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (601)..(601): a, c, t, g, unknown or other
  misc_feature (601)..(601): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcgccatctcctgcactggaancagtagtnacattgggtgttataactntgtctcctaggtaacccaacaccacccgaggaccaaacgcccctaaactcatacatttatgacgtctactcacgtccgccctcgtaacgggttctactcgtcttctctggctacagttcgacacacgcctccntacctattccgngggcctaccgaggtcgtaggtacggacgaggtctagtttaattttcgtagtcctcctctattactacgaggacagacacgacctccgttatacgtacgtaccggacgtacggaccgtacgtccgtacccgttaccgtaacgtccgacgacccgtacggacccaacccgatccgtacacctccgttaccgttccccgtaccctccgccgttacgtacgtaccgtacgcgtacgtaccggnggtaccgg

SEQ ID NO: 281350 - DNA, 755 bp, Homo sapiens
  misc_feature: GYAE6OF02HV051.38.38.D05.1.454.CMB.1.raw
  modified_base (201)..(201): a, c, t, g, unknown or other
  misc_feature (201)..(201): n is a, c, g, or t
  modified_base (273)..(273): a, c, t, g, unknown or other
  misc_feature (273)..(273): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacngttggtgttataactatgtctctaggtaaccaacacaccaggaccaaacgaccccaaactcatactatttangtacgtcactcacgtcgccctcgtacgggttttactactccgtctttctcgttcggccttaccgttaaggtttcgacctaaccgtaccggtcccctacccgttacggaacccttagttttccggtcggggtaccctcccggtaagggtcccgttagggaaaccgggaaccggttaacggggtcctttaaaggtttaaacgtttttttacgttccgttaccgttacccttaacttacgttaacttacggacggtacgacgaccgacgtaccctaacccgtttaacgttccggttacgtttaccggaaccggtacgggacccgtaaacgggtacccgacccgttacccgtaacgtacccgtaaccgaacccgtaacccgggaaccctaaaccccgtacgtaccgtaccttaccgttccgttaacccgttccccgtccctccgtaccgcgttacgcctaccgtacgtcggtaccggtcggtccgg

SEQ ID NO: 281351 - DNA, 628 bp, Homo sapiens
  misc_feature: GYAE6OF02IPY5Z.38.38.D05.1.454.CMB.1.raw
  modified_base (245)..(245): a, c, t, g, unknown or other
  misc_feature (245)..(245): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(597): a, c, t, g, unknown or other
  misc_feature (595)..(597): n is a, c, g, or t
  modified_base (599)..(600): a, c, t, g, unknown or other
  misc_feature (599)..(600): n is a, c, g, or t
  modified_base (602)..(603): a, c, t, g, unknown or other
  misc_feature (602)..(603): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (617)..(619): a, c, t, g, unknown or other
  misc_feature (617)..(619): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(628): a, c, t, g, unknown or other
  misc_feature (626)..(628): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggcaaagccccaaactcatcatttatgacgtcactcatcggccctgaggggtttctactcgcttctctggctccaagtttgcaacncggcctcctgacctatttcgtgggactccaggctaggacggacgaggtctaggttaatttttacttcgccttcctactattactaacgaggcagacctacgcctaccccttttagtccgttacgttacggaacgttcgggaaccctaacgggtccctaaccggttcccgtaacgttccaaccggtaccctaaacgggaccccctaaaccccgtacgttccgttacctaaccgttcctttcccggtttaccccgtccccttacccctaccgtaacggttcgtaaaccttcggaactgggaaccggccgggtcgtacggaccgaaggccggtacagtacggctacncncncnnncnncnncacncgcncnntcnnncncnncnnn

SEQ ID NO: 281352 - DNA, 673 bp, Homo sapiens
  misc_feature: GYAE6OF02HOPSJ.38.38.D05.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancgagtagtgactagttggtgttaanaactatcgtctcctggtaacccaacaacacccgaggaccaaacgccccaaactcatcatttatcgacgtcactcatcggccctcgtacggggtttctacgtcgtcttctcgtcggtctccgtaagtttcggaccaaccgaccggtccctcccgtcgtaccctatttcgtcgggccttccgaaggtctgggaacggacggacggtcgttacgttaaagtttttacgtgtaccgtttccccttaatacttaactaaccgtaggtaccaagccgacgtaccctaacccttagtcgttccgttacgggtacgtacgggaccgtaacggtccgtaccgttccgtaacgtccacgtacccgaacggtacccaacccctacgtccgtacgaccgttaccgtcccgtacccctaaccctcccgtaccgtacggtctacgtccgtacgtcggtaccgtcgggtaccg

SEQ ID NO: 281353 - DNA, 541 bp, Homo sapiens
  misc_feature: GYAE6OF02GI9VM.38.38.D05.1.454.CMB.1.raw
  modified_base (476)..(476): a, c, t, g, unknown or other
  misc_feature (476)..(476): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgacgtcactcatcggccctcaggggtttctactcgcttctctggctccaagtttggcaacacggcctccctgaccattctgggctccaggctgaggacgaggctgtaattttatgctcctcatatacaggcagcacgccaacccttatcgtcttccggaactgggaccaaggtccaccgtctacgtcacgcccaacggcccaacccnctcgcaccttctcgttaccccacccgtcctccgtacgtcgactccggtactcggacgccggtacg

SEQ ID NO: 281354 - DNA, 820 bp, Homo sapiens
  misc_feature: GYAE6OF02GW7J4.38.38.D05.1.454.CMB.1.raw
tcagtcgatcacgtcacgaccggtgctcgatttagtatctgatagttgggtttgggggctttgcctggggctctgctgctcctcaccctcctcactcagggcacagggtcctgggcccagtctgccctgactcagcctgcctccgtgtctgggtctcctggacagtcgatcaccatctcctgcacctggaagcacgttagtgacattgggtggttaataactatgtctctaggtaccaacaacacccaggcaaacgcccctaaatcatcatttatgacgttctacgtcatccggccctacgtacggggtttcctaccgtcgtccttcctctacggtcctacgtaaggttttcggaccaacgaccggtcccttccctacgtaccttagtttaccgtcgggtcctaccgaggtacgttggacgggtacggtacggtcgttacgttaagtttttaacgttcggtaccttaccgttacaacgtttaacgtaccggtaacgtccgtacgaccgtaccgtaccctaacccgtttagtccgtttaccgttacggtaaccgttaccggggtaaccgttaacgggttaccctaacccggttacccgtttaccggtaaccgtaccggtaacccctaaaccgggtaacccccgttaaaccccgttacgttacccggttacccgtttacccggtttacccgttttaccccgggtttaacccccccggtaccccggtttaacccggttaccccggttaaccggtttaacccggttaaccggttacccggtaacccggtttaacggggacccgggggtaccggttaccccgggg

SEQ ID NO: 281355 - DNA, 585 bp, Homo sapiens
  misc_feature: GYAE6OF02FQDDA.38.38.D05.1.454.CMB.1.raw
tcagtcgatcacgtcacgaccggtgctcgatttagtatctgatagttgggtttgggggagagaggagccttagccctggattccaaggcctatccaccttggtgatcagcactgaccaccgaggattcaccatggaactggggctccgtgggttttccttgttgctattttagaaggtgtccagtgtgaggtgcagctggtggagtctgggggagcctggtcaagccgtggggggtccctggagactctcctgtgaagtctctggattctccttcagtacttatagcatgaattgggtccgccagacctccgaggggaaaggggctagggaggtggggtccgcgattcatcagtactacgtgggtatttcagtatactacgcacgacttcggtggaacgggacctagttccacctatttcccgaagtacgacaaacggaccaaaggtacgggtacacttgtaactctcgactaaagtggacagcctgaggtgtcgacgacgacggctgtgtattcgtgtcgcgacgtcgtaccggaaacgttgttaacgtacttagtggtatacggtatactacgtccccgtcgg

SEQ ID NO: 281356 - DNA, 698 bp, Homo sapiens
  misc_feature: GYAE6OF02HF7H4.38.38.D05.1.454.CMB.1.raw
  modified_base (427)..(427): a, c, t, g, unknown or other
  misc_feature (427)..(427): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctggtctcctggacagtcgatcaccatctcctagcctacgtaggacgcgtagtagtacgattagttggttagttaactaacttgttcgtcctcgtacgtaaccaacgaccaccggagacgaacccaccctaactactatacttattagtacgtacgtactactcacgtccccgtcctacggttacggtttacctacgtcgttccttctcgtcggtcctacgttaacggttcgaacctaacgcccgtccctccgtacctaactttgttccgtcggcctacgngtcgtaggacggtacgtcgtacttaacgtttattttacgtccgtaccgttcctagtaacttacgtacgtacgtacgacgacacgtaccctaacttgtaccgttaccgtacggacggtaccgtaaccgtacgtacccgtacgttccgtacgccgaaccgtacccgaaccgtacccaaccgtacctacgtacctacgttcctacccgttacccttaccctaccgacctaccggtacgtacctaccggtaccgtaggtaccgggtcccggtacg

SEQ ID NO: 281357 - DNA, 674 bp, Homo sapiens
  misc_feature: GYAE6OF02HQDH8.38.38.D05.1.454.CMB.1.raw
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatcctcctgcactggaagcagtagtgacagttggtgttaataactatgtcctccgtaggtacccaacaaccaccaggaccaaacgccccaactcatctatttangacgtcactcatccggccctcgtaggggtttcctactcgtcttcctctgtcctcctaagtttcggacaaccgaccggtccctcccgtgaccttactttcgnggtcctccgacggtcgtaggacggacggtacggtaccgttagtaattttttacgttcgccgttaccctacttattaacgtacggacggacgagaccgaacgtccccttacccttagtttccgtcgttacgggaccgtacgggaacctaacggtccctaccgtacccgtacgtccgaacgacccgaaccgtcccaacccgtactccgtaccctaccgttccgtacccgttccccctacccttcccgtacgaccgttacggtaccgtaccgtacggcggtaccggtccgggtacccgg

SEQ ID NO: 281358 - DNA, 697 bp, Homo sapiens
  misc_feature: GYAE6OF02IDGG7.38.38.D05.1.454.CMB.1.raw
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataaatatgtctnttggtaccaacatacaccaacntcacccaggacaaacgtccccaaatcataatttatgagtacaactaaaccggccctcgaaggtagttttactaatccgtctttactcgtggcctacaagttctggaccaaacnccggccctccctgacctatcctcgtggcctacccgaaccgtaggacggaccgtacggaccgtactaacttaagtttacttgtactacggtactactaacgttaactaaccgtaaagaccgtagtaccgttacgttaccggttcggggttaggttaccgggaccgggtaacggggtacccggtaccgtacgggtacccgttacggttacgggtaccgtacggcccgtaaacgggtccgtccgtccccccgttacgggttcccttacctcccggttacccgtttccccgtacccccgttccctaccgtccggttaccgtacgttaccggtaccgtacgggg

SEQ ID NO: 281359 - DNA, 690 bp, Homo sapiens
  misc_feature: GYAE6OF02FXTY7.38.38.D05.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtgttataactatgtctcctggtaaccaacaaccnccaggcaaacgccccaaactcatcatttancgacgtcactcacgtccgcctcgtagggtttctacgtcgtcttctcgtcgtcctctaagtttcgacaacgacggtccctccctcgtaccttacgtttcggcggtaccttccgacgggtctagggacggaaccggtacggtaccgttagttaacgtttttagtcgtcccttcctacgtactaatacgacggctacgccgaccgtacccttaacccgtttgtacgtttcgtaaccgggtacgtacgggaacccgttaaggtcccgacccgttaccgtacgtaccgaaccgacccgtaaacgacccctaaacccgcttaccgaccgttacccgtccggtttccccttaccccgtccccttcccgtacccgtacggttacgaaccggtttacccggtacgtacgggaccggttcgggtaccggg

SEQ ID NO: 281360 - DNA, 682 bp, Homo sapiens
  misc_feature: GYAE6OF02GPBDI.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacaccaggacaaacgccccaaactcatcatttatgacgtcactcacgtccggccctcgtaggggtttcctacgtcgtcctttctcgtcggtcctaccgtaaggttttcggactaaccgaccggcccttcccgtacgtacctacttttcgtcggggtcctccgagggtctaggacgggacgaggtcgttaggttaaacttttagttcgtccttacctctaattactacgacggacacggcctaacgccctaacccgtttatcggttaccgttaccgggtaaacgtcgggtaaccctaaggttccctacccggtccgtaccgtccgaaccgacccgtaaccggacccaaaccccgtacgtcgtacctaccttccgtaccgtttcccccgtaccctcccgtaccgtaaccgttacgtacgtaccgaacgttcggtacggtccgggtaaccgg

SEQ ID NO: 281361 - DNA, 588 bp, Homo sapiens
  misc_feature: GYAE6OF02H9Q3W.38.38.D05.1.454.CMB.1.raw
  modified_base (271)..(271): a, c, t, g, unknown or other
  misc_feature (271)..(271): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
  modified_base (575)..(578): a, c, t, g, unknown or other
  misc_feature (575)..(578): n is a, c, g, or t
  modified_base (580)..(582): a, c, t, g, unknown or other
  misc_feature (580)..(582): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
tcagtcgatcacgtcacgaccggtgctcgatttagtatctgatagttgggtttgggggctttcgtctgggtctcctggacagtcgatcaccatctcctgcactggaagcagtagtgacattggtggttataactatgtctcctggtaccaacaacacccaggcaaagcccccaaactcatcatttatgacgtcactcatccggccctcgaggggtttctactcgcttctctggctccaagtttggcaacacggcctcctgacctattttcngggctccaggctgaggacgaggctagtaatttttattgccttcctactatatacaggcagcacgccacccttatcgtcgttacggaacgtcggaaccctaaggtccaccgttcctacggtacaacgtcccgaaacggcccaacccctacgtcgtaccctaccgtttccttccggtttaccccccacccgttccctccgtaccgttagactacccggagttggaaccggccgggtacttcgggacccgaaaggggtcccgaacgtacgtaacggncgcgnctacgnanncncncacngcnncncnnnncnnncncnnc

SEQ ID NO: 281362 - DNA, 631 bp, Homo sapiens
  misc_feature: GYAE6OF02HCOTE.38.38.D05.1.454.CMB.1.raw
  modified_base (270)..(270): a, c, t, g, unknown or other
  misc_feature (270)..(270): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatctatttangacgtcactcatccggccctcgtagggtttctactcgtcttctctggctcctaagttgcaacaccgcctcctnacctattcgngggtcctccgaggctggagacgagctagttaattttagttcgacttcctactaatactaacgaggaccagaccacgaccctaacccttactcgttaccgttacggaaacgttcgggaaccctaaggtccctacccgtccctaccgtaccaccgacccgaaacggacccccaacccgtaccgtaccgttacctaaccttccgttcccgttaccccgtacccccttaccgtcccgtacggttcgtaccgtaccgtaccgtcggtaccggccggtacccgg

SEQ ID NO: 281363 - DNA, 711 bp, Homo sapiens
  misc_feature: GYAE6OF02HX1F5.38.38.D05.1.454.CMB.1.raw
  modified_base (286)..(286): a, c, t, g, unknown or other
  misc_feature (286)..(286): n is a, c, g, or t
tcagtcgatcacgtcacgaccggtgctcgatttagtatctgatagttgggtttgggggtctttgcctgggctctgctgctcctcaccctcctcactcagggcacagggtcctgggccagtctgccctgactcagcctgcctccgtgtcgtgggtctcctggacagtcgatcacatctcctgcactggaagcagtagtgacattggtgttaataactatgtctctggtaacaacaacaccaggacaaacgaccccaaactacatactaattatagactcactactancggaccctcgtacgggtttcactcgcttctctgcctacgtaagtttcggcaaacgtccggcctaccgtcgtaacctacgtttcgtacgggtcctaccgacggtcgttacggacgggaaaccgtagggtccgttaacgttaaattttttaacgttacggtcccttcccgttacgttaacgttaaacttaaccgaagggtacctaacggaccgtacgtacccttaaccccgtttactacggtttaccgttaaccggtaaaccggttacgggaacccgtaaacggtcccgtaaccgtcccgtaacgtaccgaccgacccgaaccggtacccaaacccgtacgtacaccctacttcctccggttacccctcccgtcccttaccgaccggttactacgtacccgtaacggtacgtaccgggtcggtacgg

SEQ ID NO: 281364 - DNA, 635 bp, Homo sapiens
  misc_feature: GYAE6OF02G9VA8.38.38.D05.1.454.CMB.1.raw
  modified_base (600)..(600): a, c, t, g, unknown or other
  misc_feature (600)..(600): n is a, c, g, or t
tcagtcgatcacgtcacgaccggtgctcgatttagtatctgatagttgggtttgggggagagaggagccttagccctggattccaaggcctatccacttggtgatcagcactgaccaccgaggattcaccatggaactggggctccgttgggttttccttgttgctattttagaaggtgtccagtgtgaggtgcagctggtggagtcgtgggggaggcctggtcaagccgtggggggtccctgagactctcctgtgaagtctctggattctccttcagtacttatagcatgaattgggtccgccagacctccgaggggaacggggctgggaggtgggtcgctagttcatcagtactacgtgggtagtttcatatactacgacgtagtacgttggtaggaacgggtccgtacttccgacctactttaccgaagaacgaaccgaaaccgaccaaaggtacggtactaacgtgtaactctagaactaagtacggacagccgtaggtagtcgtaccgacgacgtcgggtcttggtcgttaattacgtgtacgtacgtaccgtaccggtaaacggtaaaaccgtttgttaaccgtaattttaggnggttacggtataccgtactaccgttcccgtacggg

SEQ ID NO: 281365 - DNA, 796 bp, Homo sapiens
  misc_feature: GYAE6OF02JPT9T.38.38.D05.1.454.CMB.1.raw
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
  modified_base (636)..(636): a, c, t, g, unknown or other
  misc_feature (636)..(636): n is a, c, g, or t
tcagtcgatcacgtcacgaccggtgctcgatttagtatctgatagttggtttgggggtcgtttggtcctgggcgtctggctgctcctcacctcctcactcaggcacaggtcctggcccagtctgccctgactcagcctgccctcgtgtctgggtctcctggacagtcgatcaccntctcctgcactggaancagtagtgactattgggtagttaatactagtcgtctcgtggtaaccaactaaccacccgaggcaaaaccggccccaaactcaatcctaatttatacgaccgttacaccgttacctacgtccggacccttcggtaacggggtttcctaacctcggtcctttcgtcgttcggtccgtaccgttaaacggttcggacctaaaccggtccggtacccttcccgtaggacccttagttttccggacgggttcccgtaccgacggtccgtaggtaaccgggacggtacggtaccgtacgttaaagtttttccgtacgttaccgtcccttaacgaagttaccgtaacgaccggtcgaaggtacccacggtaccctacccggtttaatcgttaccgttcgggaaaccttcgggaaccgttaacggtccaccggttaccctacgggttaacccncggtaaaccccggtaagacccccgtaacccctaggttacccgtccgttaaccttccccgtttccgggttacccccccttaccgtaccccctttaccggaaattccccgggttaaccgtccgttaaacccggtccgggttaccgggtacccgggttaaccg

SEQ ID NO: 281366 - DNA, 752 bp, Homo sapiens
  misc_feature: GYAE6OF02HCW9H.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctggtaccaacacaccaggacaaacgccccaaactcatactattatgacgtcactcacgtccggccttcgtagggtttctacgtcgtcttctcgtcggcctccgtaagtttcggacaacgaccggtcctcccgtacaaccttacgtttcgcgggtcctaccgtacggtcgtaggacgggaacgtacggtaccttaggttaaacttttttagtcgtaccttacccgtatacgttaacgttaacgtaacggaccaaggtaccgaaccgtaccccttaaaccccgtttaagtccgtttaaccggtttacccgggaaaccggttacgggtaaaccccgtaaggttaaccccgacccggtttaccctaaccgtaccgtaaccggaaccccgttaaaccgggacccctaaaccccgtacgtaccgttaccgtaacccgtttaccgttaccccggtttaccccctacccgttacccgttacgtaccgttaaccggaccgttaacccggtacgttaccgggaacggtccgggtaaccg

SEQ ID NO: 281367 - DNA, 692 bp, Homo sapiens
  misc_feature: GYAE6OF02F5U9X.38.38.D05.1.454.CMB.1.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagtcgatcacgtcacgaccggtgctcgatttagtatctgatagttgggtttgggggctttgcctgggctctgctgctcctcaccctcctcactcagggcacaggggtcctgggcccagtctgccctgactcagcctgcctccgtgtctgggtctcctggacagtcgatccaccatctcctgacacgtaggaagctagtagtgactgttggtgttaataactntcgtctcgtgtaaccaacaccnccgaggacaaccgaccccaactcactactattatcgacgtctactcagtccggtccctacggtacgggtttcctacgtccgtcgttctacgtcgtactacgttacggttcgactaccgtaccggtccctaccgtactacctacgttttcgacgggtcctacgtacgcgtaggacggacgtcggtacgttagttacttttagtcgtccttacgtacagtactaggacggtacagtacctacgtcccttaaccgttgtccggtttacgtaccggtaacggtacggtaaccgtaccggttaccgacccgttccgtaaccgtcgaacccgtcccggaacctacccgaacccttagtacctaccgtcctccggttcccgttaccccgtccccgttcttaccggcgttacggtacccgtcggttaaccggcgtacgggtcccgttaaccggg

SEQ ID NO: 281368 - DNA, 795 bp, Homo sapiens
  misc_feature: GYAE6OF02HN6A6.38.38.D05.1.454.CMB.1.raw
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctcgccctgacctcagcctgccgtccgtgtctgggtctcctggacngtcgatcaccntctcctgcacgtaggaancgagtagtcgactagtttgggtggttaactaacgtattcggttcctaccgtacggtaacccaaacgaaccacccgtaggaccaaaaccgcccccaaaatccaactactactttagcgtacgtactactcactccggcctggtacgggttctactcgtacttcgtacgtcggactactaggttcgcctaaccgaccggtcccttaccgtacgtaccttacgtttcggtacgggtccctacggacgggtctacgggaacggtaccggtgggtaccgtttagttaaacgttttttacgtccggtaccttacccgtaagtaacttaaacggtaccgtaacggacgtacgacgtaacccggtaccttaaacccgtttgttaccgttaccggttaaccggtaaccgttacggggtaacccgttaaacggtccccgttaaccggttacccgtaaccgtccggacccgttaaccccggaaacccggtacccctaaccccgggtaacttcggacccttccgttacccggttcccggtccccctaccgttcccgtaaccggtacgtaccggtaccttccggtacgttaaccggggcgtaccgggtcccgg

SEQ ID NO: 281369 - DNA, 546 bp, Homo sapiens
  misc_feature: GYAE6OF02FZ48E.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcatcatttatgacgtcactcatcggccctcaggggtttctactcgcttctctggctccaagtttggacaacacggcctccctgacctatttctgggctccaggctgaggacgaggcttagtaatttttatgtctcctctatatacagcagcagcctacccttatgttcgttacgaacgtggaccaaggtccaccgtcctacgtcacgccaacgcccaacccactcgtccaacctcgtccgttccccgcccctcctcctacgtcgtactccgactcgacggcggtacgg

SEQ ID NO: 281370 - DNA, 748 bp, Homo sapiens
  misc_feature: GYAE6OF02IFSJH.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtggttataactattcgttcttcctaggtaacccaaacaaccacccaggaccaaaacgccccaaaactcattcatttatgacgtcactcagtccggccctcgtagggtttctactcgtcttctcgtcgccttaccgtaagtttcggactaaccgtaccggtcccttaccctacgtaaccctagttttccgcggggtacctacccgtacgggtccgttagggaacgggtaaccggtaggtaccttaagttaaattttttcgtagtccctttccgtactaactaactaacgacggtacgtacgtccgtaacgtaccctaaccccgtttataccggtttaccgttacccgggtaaaccggtcgggtaaaccctaacgggttacccctaaccggttacccgtaacccgtaccgaaccggttaaccccgaacggtacccaaacccctaccgtaccgtacctacccgttccgttaacccggttccccacccgtttacccctccgaccgttcgaacgtttccgaccgtaggtacccggtcgggtaccgg

SEQ ID NO: 281371 - DNA, 581 bp, Homo sapiens
  misc_feature: GYAE6OF02HQ7DZ.38.38.D05.1.454.CMB.1.raw
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttataactatgtctcctggtaaccaacaacaccaggcaaagccccaaactcatcatttatgacgtcactcatcgcctcagggtttctactcgtcttctctgctctagttgacacncgctcctnactgttcgnggctcgaggctgagacgagctagtaattttgtcgcttctacatactacgagcagcacgacctaacccgttattcggtactaccggaacgtcgggaaccctaaggtccctaaccgttccttaacgacctacggacccctaacggtaccccaaaccctaccgttagtacccaccgttccttcgttacccccacccttccacccgtacgtcgaaccgtccgtaccgtggtaccggcggtacgg

SEQ ID NO: 281372 - DNA, 297 bp, Homo sapiens
  misc_feature: GYAE6OF02GF1RK.38.38.D05.1.454.CMB.1.raw
  modified_base (283)..(288): a, c, t, g, unknown or other
  misc_feature (283)..(288): n is a, c, g, or t
  modified_base (290)..(297): a, c, t, g, unknown or other
  misc_feature (290)..(297): n is a, c, g, or t
tcagtcgatcacgtcacgaccggtgctcgatttagtatctgatagttgggtttctactcgcttctctggctccaagtttggcaacacggcctccctgacctattctggctccaggctgaggacgaggctgaatttatgctcctcatatacaggcagcagcacccttatgtctcggaactgggaccaaggtcaccgtcctacgtcagcccaaggtcccaacccctatgcacctctcgttccccacctctcacgtgatccgatcgagcggctggacagcgcatgnnnnnntnnnnnnnn

SEQ ID NO: 281373 - DNA, 653 bp, Homo sapiens
  misc_feature: GYAE6OF02G8NT8.38.38.D05.1.454.CMB.1.raw
  modified_base (190)..(190): a, c, t, g, unknown or other
  misc_feature (190)..(190): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtggttataactatgtctcctggtaccaacaacacccaggcaaagccccaaatcatcatttangacgtcactcatcggccctcgagggtttctactcgtcttctctggctctaagttcgcaacncggcctcctgacctatttcgtcgggtcctccgaggtctaggacggacgtaggctgttaatttttacgttcggtccttccgtactaatactacgcggcacgcacgtcctaacccgttatcgttacgttacgggaacttacgggaaccaacgggttcctaacccgttccgttaccgtccgtaaccgccccgaaacggtccccaaaccccgtacgttaccgtaccctaccttcccgtcccggtttaccccctaaccccgttcccgttacccgtaacccggttcgaacccgttaccgtaaccggtcgggtaccgggtccgggtacccgg

SEQ ID NO: 281374 - DNA, 593 bp, Homo sapiens
  misc_feature: GYAE6OF02FU0GP.38.38.D05.1.454.CMB.1.raw
  modified_base (269)..(269): a, c, t, g, unknown or other
  misc_feature (269)..(269): n is a, c, g, or t
  modified_base (349)..(349): a, c, t, g, unknown or other
  misc_feature (349)..(349): n is a, c, g, or t
tcagtcgatcacgtcacgaccggtgctcgatttagtatctgatagttgggtttggggctttgcctgggctctgctgctcctcacccgtcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcgatcatttangacgtcactcatcggccctcagggtttctactcgtcttctctggctctaagtttgacacacggcctcctgacctatttcnggctccgaggctagaggtacgaggcttgtaacttttatgtacttcctacatactacaggtcagcacgcctacccttagtcgttccttacggaacgtcgggaacctaaggtccaaccggtccctaacgtccgacgtacccgaacggccccaaccccgacttcgtaccaaccgtccgttcggttaccccgcccgttccctccgtaccggtcgtaccttaccgtaacgtcgacgggtccggtaccgg

SEQ ID NO: 281375 - DNA, 651 bp, Homo sapiens
  misc_feature: GYAE6OF02IY0LV.38.38.D05.1.454.CMB.1.raw
  modified_base (408)..(408): a, c, t, g, unknown or other
  misc_feature (408)..(408): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctaggtaccaacacacccaggacaaacgccccaaactcatctattatgacgtcactcatccgaccctcgtagggtttctactcgtcttctctcggactcctagttcggacaacgcgtcctcctgactattctcgggcctccgaggctgacggtacgagtctagttaattttgtacgtcgtcctanacttagtacgaggtcgacgtccgacgtaccgttaacccttagtacggttaccgttcgggaaaccggttacgggaaccctaaggttcccgtaacccggttccctacgtaccgaccgtacccgaacccggtacccaaccccgagttccggtaccctaccgttacccgttccgttacccccggtacccttcccgtaccgtaacggttccgacctaccggtcggtaccgcgggtcccgggtaccggg

SEQ ID NO: 281376 - DNA, 565 bp, Homo sapiens
  misc_feature: GYAE6OF02I57UU.38.38.D05.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacagttggtggttaataactatgtcctcctggtaaccaacaacacccaggacaaacgccccaaactcatctattatgacgtcactcatccgcctcgagggtttctactcgcttctctcgctcctaagttcgacacgacgcctcctgacctattcgtgggtcctcgaggctggacgacgaggctagtaattttatgcctctacatactacgaggcagacacgacctacccttatcgttcgttacgacgtaggacctaaggtcctaccgtcctaccgtcgacgacccaacgacccaaccctctactctaccgttcctccgttccccaccctcctaccgtacgtacgactccgacgtcgacggcggtacg

SEQ ID NO: 281377 - DNA, 637 bp, Homo sapiens
  misc_feature: GYAE6OF02HTDIS.38.38.D05.1.454.CMB.1.raw
  modified_base (191)..(191): a, c, t, g, unknown or other
  misc_feature (191)..(191): n is a, c, g, or t
  modified_base (423)..(423): a, c, t, g, unknown or other
  misc_feature (423)..(423): n is a, c, g, or t
tcagtcgatcacgtcacgaccggtgctcgatttagtatctgatagttgggtttgggggctttgcctgggctctgctgctcctcaccctctcactcagggcacagggtcctgggcccaggtctgccctgactcagcctgcctccgtgtctgggtactcctggacagtcgatcaccatctcctgcactggaancagtagtgactattggtgttaataactatgtactcgtaggtaaccaacaacacccaggaccaaaacgccccaaactcagtctatttatcgacgtcactcatcggcctgagggtttctactcgcttctctggctctaagttggcaacgcgtcctcctcgactcgttcgcggctcgagctagaggacgaggtctagttaatttatcgcctcctatatactacgagtcagcgacncctaacccttagtcgtacgttacggaacgtcgggaacctaggtacccgtaccgttaccgtacgtacgaccgtaacccgaacggtacccctaaaccccgtacgtacgttaccctaccgtttacccgttccggttaacccccctaccgttcccgtttaaccgtacggttaccgtaccttaccggtaccgtacgggtaccgggtaccggtaaccggg

SEQ ID NO: 281378 - DNA, 775 bp, Homo sapiens
  misc_feature: GYAE6OF02HKGI7.38.38.D05.1.454.CMB.1.raw
  modified_base (191)..(191): a, c, t, g, unknown or other
  misc_feature (191)..(191): n is a, c, g, or t
tcagtcgatcacgtcacgaccggtgctcgatttagtatctgatagttgggtttgggggctttgcctgggctctgctgctcctcaccctcctcactcagggcacagggtcctggcccagtctgccctgactcagcctgcctccgtgtctgggtctccgtggacagtcgatcaccatcctcctgcactggaancgagtagtgacagttggtagttactaactatgtctcgtagtaaccaacaacaccgagaccaaacgccccaaatcatcgtaattatacgacgtcactcactccgcctacgtacgggtttcaacttcgtacctttctacgtcggtactaccgtaaaggtttcgaccaaaccgtaccggtacccttcccgtaggtaacccttacgtttcgtacgggtaccgttaccgacggtcgttaacggaacgggtaccggtacggtaccgtttaggtaaactttttttcggaacttcccttaccgttactaaacgttaacgtaacgtaacgggtacaacggtacacgaccccgtttaaccgttagtttaccgttaaccgttaccggtaaacggtcggtaaacccgtaacgtaccgtaacccgttaccgttaccggtacctaaccggaccgttaaacccgacccgtaaccctagttaccgtacccgttaaccgttaccgttacccggtttacccccgacccgtttaacctacccggttaacgttcggttaccgttaacccgacggggtttacgacccgggttccgggtaacccgg

SEQ ID NO: 281379 - DNA, 713 bp, Homo sapiens
  misc_feature: GYAE6OF02ILSMA.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatcctctgcactggaagcagtagtgacattggtagttataactatgtctcctggtaaccaacaaccacccaggaccaaacgaccccaaactcatcatttatgacgtcactcatccggcccttcgtacggggttttctaccgttcgtcctttccgtcgtcggtcctaccgtaaggttttcggacctaaccgtaccggccccttccgtaccgtaccttatttcgtcgggtcctccgaggtcgttaggaacggacggtaggtactaggttaatttttagttcgtccttccctactaattactaaccgtaggaccgtagaccacggtccctaacccgtttagttcgttccggttacggtaaccgtacggggaacccgtaacggtcccgtaacccggttccgttaaccgtccgaccggtaccccaaccgggaccccaaaccccgtcgttaccgtacctaaccgttcccgttaccgttaccccctaccccttacccgtactaaccgttcgtaccgtccggtaaccgtcggtaccggacggtaccgg

SEQ ID NO: 281380 - DNA, 747 bp, Homo sapiens
  misc_feature: GYAE6OF02IE69Q.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttaataactatgtctcctggtaaccaaacaacacccaggaccaaacgcccccaaactcatcatttatgacgtcactcactccggccccttcgtagggggttttcctactccgtcctttctctggcctcctaaaggttttcggacctaaacgtaccgggcccttcccctcgtaccctagttttcgtcggggtcctccgaggtcgttaggacggggaacgtagggccttaggttaaatttttttacgttcggtccctttacccgttacctaagttacgtaaccgtagggtaccacggtccgaaccgtaccctaacccccgttttattccggttaccgtttaccgggtaaaccgttccggggaaccctaaacggggttaccctaacccgggttccctaaccggttccgaaccgtacccccgtaaacgggaccccctaaacccctaccgttcggtaccctaccttaccgtcccgtttacccccgtacccctcccgttacccgacgtcgtacgttaccgaccgtcggtaccggcgggtaccgg

SEQ ID NO: 281381 - DNA, 740 bp, Homo sapiens
  misc_feature: GYAE6OF02I2CNW.38.38.D05.1.454.CMB.1.raw
tcagtcgatcacgtcacgaccggtgctcgatttagtatctgatagttgggtttgggggctttgcctgggctctgctgctcctcaccctctcactcagggcacagggtcctgggcccagtctgccctgactcagcctgcctccgtgtctgggtctcctggacagtcgatcaccatctcctgacacgtggaagcgagtagtcgactagttgggtaggttaataacgtattgttcctcccgtggtaaacccaactaaccacccgaggaccaaaacgcccccaaactcactactattatagacgtcacgtcacgtccggcccttacgtacgggtttactacgtaccgttcttcgtcgtcggtacctaccgtaagtctacggtacaaccgaccgggtccctaccgcgtaacctacgttccgtccgttcggggtacctaccctaaaccgtggggaacgtaccggacgggtcccttacgtaacgtttacttacgtacgtcaacgtccgtataactaacgtaacgaacgtaccgacgtaccgttcgtacgttgggttccggttacgggacgggcgggtaaccgtaccgtagggtacccgttacgttaggtaccgaacccgtaaccggaccgtaccgttcccgtacccccgttcggtacccttacggttaccctttccccggtacccgtacccctttccggacccgtacggttacgtccggtacggtaccggtcggaccggttaccggg

SEQ ID NO: 281382 - DNA, 704 bp, Homo sapiens
  misc_feature: GYAE6OF02H2TJB.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctctgcactggaagcagtagtgactagttggtaggttataactatgtcctcctggtaaccaacaacaccaggacaaacgcccaaactcatcattatgacgtcactcactcggccctcgtacgggtttctaccgtcgtcttcctcgtcgtccttaccgtaaggttttcggacctaaccgtaccgggtccccttacccctcgacccttattttccggtacgggtccctccgaacggtcgtaggacggtaacggacggtcttaggttaaacttttttagtcggtccttccgtataacgttaactacgaacggtcgtaacgaccgacgtacccttaaccctttagttcggttacttaccggggtaacgtaccggggaacccgtaacggtacccgtaccccgttaccgtaaccgttccgaaccggtcccgaaaccggaccccaaacccgcttacggtccctaacttcccgttacgtccccctaccgtccctaacgaccgttacaccgtccgtaccgtaggccggtccgggtacg

SEQ ID NO: 281383 - DNA, 663 bp, Homo sapiens
  misc_feature: GYAE6OF02IA06W.38.38.D05.1.454.CMB.1.raw
  modified_base (174)..(174): a, c, t, g, unknown or other
  misc_feature (174)..(174): n is a, c, g, or t
  modified_base (222)..(222): a, c, t, g, unknown or other
  misc_feature (222)..(222): n is a, c, g, or t
  modified_base (595)..(595): a, c, t, g, unknown or other
  misc_feature (595)..(595): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccntctcctgcactggaagcaggtagtgactagtttggtaggttataactnttcgtccttccgtaggtaaccaaacaaccacccgaggtaccaaaacgtcccccaaaactctactctaatttatcggaacttcactactagtccggccctcggtacgggtttctactcgtcttctctggctacctaagttcgacaacgccgtcctcctagacctattcggtcgggacctccggagtccgtaggacggacgaggtacgttagttaaattttcgtcgccttccgtacttaacgtactaacggacgcgagtaccacgtaccctacccttagtcgttactaccggtaacgttacggacctaaggtccctaccgtccgtaacgtccgaaccgaccgaaaccggaccctaacccgtacgttccgtaaccncttaccgtcccgtccctaacccgtccctacgtacgtcgtactaccgtacgtcggtacggtccggacgg

SEQ ID NO: 281384 - DNA, 719 bp, Homo sapiens
  misc_feature: GYAE6OF02F5179.38.38.D05.1.454.CMB.1.raw
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggancagtagtcgactagttggtgttactaacgtntgtcctcgtcgtaaccaacaacacccgaggaccaaacgccccaaactcactactaatttacacgtactacgtactacacgtccgtacccgttcgtacgggtttacctcgtcgtccttctcgtcgtcgtctaagtttggacctaaccgtccggtaccttccgtacgtaccgttacgtttcgtcgggtcctaccgtacggacggttcggaacggacgtaggttacgttaacgtttaatttttacgttcgtcccttccttaaacgaattaaccgtaccgtaacggactaggacccacggttaccccttaaccctttggtactttacccggtacggtaacggtaccggtaaccgtaacgtcccgtaaccgtcccgtaacgtaccgaacgttacccgaaaccgtacccaaacccgtccttaacggctaccgttccgtaacctaccccctaaccgttcctaacgtaccgtagtaccgttaccgaacggtacgtccggtacggtcgg

SEQ ID NO: 281385 - DNA, 700 bp, Homo sapiens
  misc_feature: GYAE6OF02IE1FT.38.38.D05.1.454.CMB.1.raw
  modified_base (616)..(616): a, c, t, g, unknown or other
  misc_feature (616)..(616): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattggtggttataactatgtctcctggtaccaacaacacccaggacaaacgaccccaaactcatctatttatgacgtcactcatccggccctcgtagggtttctactcgtcttctcgtggtctcgtaagtttggacaacgaccggtccctcctcgacctattttcgcggcctaccgaggcgtgacggacgaggtctagttaatttttagtcgccttacctataacgttaactaaccgacggacacgtacgaacgtccctaaccctttagtcggttaccgtttaccgggaaacgtcggaacctaaggtccaccgtcctaacgtaccacggaccccgaacgaccccaacccctacttacgtaccctactttccgtccgttccccccgacccttacctacgtacggtacgtacgtacccgtagttcgggaacgggtccggacgtcgggaaacccgtaaggggccccgtaaactaggtaaccgagtccgagtacgtccgaacncgtagtacgacgtacgtacgtacgtacgtacgtacgtacgtactacgtacgtacgtacgtacgtacgtacgtaccgtacgtacg

SEQ ID NO: 281386 - DNA, 646 bp, Homo sapiens
  misc_feature: GYAE6OF02FIQT0.38.38.D05.1.454.CMB.1.raw
  modified_base (192)..(192): a, c, t, g, unknown or other
  misc_feature (192)..(192): n is a, c, g, or t
  modified_base (283)..(283): a, c, t, g, unknown or other
  misc_feature (283)..(283): n is a, c, g, or t
  modified_base (489)..(489): a, c, t, g, unknown or other
  misc_feature (489)..(489): n is a, c, g, or t
  modified_base (587)..(587): a, c, t, g, unknown or other
  misc_feature (587)..(587): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgacctcagcctgcctccgtgtctgggtctcctggacagtcgatccaccatctcctgcactggaancagtagtgacagttgggtagttactaactatgtcctcgtggtaaccaactaacaccctaggaccaaaacgccccaaactcatcattttagnacgtcactcactcggccctcgagggtttctactcgtctctctgctctaagtttggacctaacaccggtcctccctcgtaccgtactttcgtcgggtaccttaccgacggtcgtacggacgggacggacgggccttagtaaacttttgtacgtccttcctactaatactaacgtcggactacggaccacgtccctaaccccgtttancgttacgttacccgggacgtcggggtaaaccctaagggtcccaccgtacccgtagtaccgacgtacccaacgaccctaaccccgtagttcgcctaccnctttccggtcccccgaccctccgtaccacgttcgacgttccgacgcgtacggcgtaccg

SEQ ID NO: 281387 - DNA, 619 bp, Homo sapiens
  misc_feature: GYAE6OF02I48G6.38.38.D05.1.454.CMB.1.raw
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (587)..(587): a, c, t, g, unknown or other
  misc_feature (587)..(587): n is a, c, g, or t
tcagtcgatcacgtcacgaccggtgctcgatttagtatctgatagttgggtttggggctttgcctgggctctgctgctcctcaccctcctcactcagggcaccagggtcctgggcccagttcctgccctgactcacgccttgcctccgtgttctcgggtcctcctggacngtcgatcaccnttcctcctgcactaggaacgcagtatcgactagttggtagttaactaactagttcgtcctacgtacgtaaccaacaacccgaccgacggaccaaaccgacccctaaatcatactaagttancgactcactctacgtcgcccgtcgtacggttcacctcgtcttcncgtcgtacctcgtacgtcgacaaccgcccgtctacctntacctntcgtcgactcgtgcgtagaggcgtagtctagttactttcgtctctacctanaactgtaacncgtanacgcacgtcctaaccttgttccgtacgtccggaacgtcggtaaccgacgtccgtacgttccgaccgtcacccggacgaccgaccctacccgctaaccgtccgtcctccggttccctaccccttactccgcncgttacgctaacggcctacggccgacggtccg

SEQ ID NO: 281388 - DNA, 776 bp, Homo sapiens
  misc_feature: GYAE6OF02FP96D.38.38.D05.1.454.CMB.1.raw
  modified_base (282)..(282): a, c, t, g, unknown or other
  misc_feature (282)..(282): n is a, c, g, or t
  modified_base (709)..(709): a, c, t, g, unknown or other
  misc_feature (709)..(709): n is a, c, g, or t
tcagtcgatcacgtcacgaccggtgctcgatttagtatctgatagttgggtttgggggctttgtctgggtctcctggacagtcgatcaccatctcctgcactggaagcagtagtgacattgggtggttataactatgtctcctggtaccaacaacacccaggcaaagcccccaaatcatcatttatgacgtcactcatcggccctgaggggtttctactcgcttctctggcttccaagtttcggacaacgaccggtcctcccctaggacccctattttccgngggtacctccgagggccttggaagggaccgtaagggccttaggtaaagttttttaactcggaccttcccgtacgtaacttacgtaaccgtacgggtctaaggtccaacggtccctaacccccgttttagtcggttccttacggggtaaaccttcgggaacccttaacgggttccaacccgtttacccggtaacttaccgaacgtacccccggtaaagggtaccccctaaaccccgtacgtaccgggtaccctaacccgtccgtttccggttacccccggtaccccttacccgtaccgtaaccggtcgtaaccggttcccgtaacgttcgggaacgtcccggggtacttacgggggaacaaacgggggtcccaccgtaacggttggtactaccgtcgtcgacctagcctagtaccgtactacggtccnggtacctcggtactaacgtccggaacttgtaccgggtaatacctacgggtcctacggtaccttacgg

SEQ ID NO: 281389 - DNA, 557 bp, Homo sapiens
  misc_feature: GYAE6OF02JJ714.38.38.D05.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagctgcctccgtgtctgggtctcctggacagtcgatcaccatctcctgcactggaagcagtatgacattggtgttanaactntgtctctggtaccaacaccaccaggcaaagccccaaatcattaattatgacgtcactcagtccggcctgtacggggtttctacgtcgtcttctctggctctagttgcacgcgcctccngacctattcgcggctcgngctgagacgagctagtacttttangctcctnatatacgagtcagcagcctaccttagtcgtcgttacgacgtggaccgacgtcgtaccgtctacgcacgacccaacggcccaaacccgtcgtacgtcctacttcgtcccgttacccgtcctacccgtccgtaacgtaccgtacgttccgaacgtcggtaccgggtcgtccgtacggg

SEQ ID NO: 281390 - DNA, 721 bp, Homo sapiens
  misc_feature: GYAE6OF02JNASZ.38.38.D05.1.454.CMB.1.raw
  modified_base (169)..(169): a, c, t, g, unknown or other
  misc_feature (169)..(169): n is a, c, g, or t
  modified_base (281)..(281): a, c, t, g, unknown or other
  misc_feature (281)..(281): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgacctcagcctgcctccgtgtctgggtctcctggacagtcgntcaccatctcctagcacgtggagctagtagtgacagttgggtgttataactatgtcctcctagtaccaacaccaccaggcaaacgaccccaactcactctattatcgactcnctcacgtccgcctcgtagggttctactcgtcttctcgtcgtccttaccgtaagttcggactaaccgacccggtccctaccacgtaacctcgttttccgtcgggccttcggaacggcgtacggtacgggaaccgtagggtcccttaaggttaatttttactttaccggtcccttacctactacgttaacttaccggacgtacgacgtccgaaccctaccgtaacccgttttataccggttaccggtttacccgggaacggttacgggtaacccggtaaccggttacccgtacccgttaccgttacggtacccggaacccgtacccgtaaaccccggtacccaacccccttagacccttacctaccgtccgtttcccgtccccgtacctaccccgtcgttacggtctaccggttcctacgtcggtacccggtaggtacccgg

SEQ ID NO: 281391 - DNA, 824 bp, Homo sapiens
  misc_feature: GYAE6OF02F4Z99.38.38.D05.1.454.CMB.1.raw
  modified_base (187)..(187): a, c, t, g, unknown or other
  misc_feature (187)..(187): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcacatctctgcactggaancagtagcgactagtttggtagttaataacttatcgtcctccgtacggtaaccaaacgaaccacccgaggaccaaaaccggacccccctaaaactcaacttctaacttttaatacggtaccgttacctaacgttcctaacgttccccggtccccgttacggttaacggggggtttttccctaacccgttccggttcccttttccgttccgttcgggtccccgttaccgtaaagggtttttccggaaccctaaaccggtacccgggtccccttcccgtacgtacccttaacgttttccggtacggtccctacggtacggtcgtaggaacgggtacgtacgggtcctttaaggttaactttttacgtacgtacccgtacctttacgtaacttaacgttacggaccgggtactacggtaccgtaccgtaccccttaaccgtttacgtacgtttaccgttaaccgggtaaccgtaccgggtaaccgtaacggttacccgaacccgtttccgtaacccgttcgaacccgtacccggaaccgtaccccaaaccgttcgttaccgtcctaccgttccggttcttaccccggtccttcccgtacgtccgtacgtacgtacccgacggttcgtacggccggtaccgg

SEQ ID NO: 281392 - DNA, 737 bp, Homo sapiens
  misc_feature: GYAE6OF02GZTV3.38.38.D05.1.454.CMB.1.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttgggtgttaataactatgtctcctagtaaccaaacaacacccaggaccaaaacgccccaaacncatacaatttangacgtcactcactccggccctcgtacggggtttctactcgtcttctcgtggtcctaccgtaagtttcggacctaaaccgaccggtccctacccctgaaccctattttccgtcggggacctccgtacggctagggacggaacggaggtacgttagttaactttttaacgtgtccttaccctactaaattaacgtaacgacgggtaccgacgactaaccggtaccctaaccccgttttaagttccgtttaccgtttaccggtaaacgtacgggtaaaccaacggttacccgacccggttaccttaccgtacccaacggaccccgaaacgggaccccctaaaacccgtaccgtacgttaccaacccgtttccgttcccggtttacccccgcccctttaccctaccgtaaccggttacgtaaccgttaaccggacccgtttagggaccggtccgggtacccgg

SEQ ID NO: 281393 - DNA, 774 bp, Homo sapiens
  misc_feature: GYAE6OF02JC4LO.38.38.D05.1.454.CMB.1.raw
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (493)..(493): a, c, t, g, unknown or other
  misc_feature (493)..(493): n is a, c, g, or t
  modified_base (728)..(728): a, c, t, g, unknown or other
  misc_feature (728)..(728): n is a, c, g, or t
tcagtcgatcacgtcacgaccggtgctcgatttagtatctgatagttggtttgggggctttgcctgggctctgttgctcctcaccctcctcactcagggcactagggtcctgggcccagttccgtcgtccctgactcagccctgcctccgtgtctgggtctccaacgttaccatcaccnctactctcgtccactcgtaacggcgacgacgtaggtacnaaaagttggttacggttacttaattaggtcttccttcggtacgtaaccaaaccaacccacggtaccgaaacacccccgaaccaaccctatctaacgttatacggttaactcgacctacctagtaccgcccgtccggtacgggtttacgttaccgggttcctaaccgtccgttctccggtacctaacgtttccggtacgtaagtttccggacgtaccccttcgacccctacgttacccttgggtaccgtgtccgacctaggccgtacgaggggacnggggtactttaacgttagttcgttcgtaaccctctataactaccggtacgtacggcctaaggccacccgttaacctaaccgttcgttaccggtacctttacggggaaccacgggtaacctacggtacccttaccggttaccgtacgtacccgtaaaccgcccgttaaacccggaccctaacccgtaccgtaaccgttcccgttactacccgtccgtaccccgtcctaccccggtntaacggtccggacgtcctaggccggagtaccgggcgtaaggtccgg

SEQ ID NO: 281394 - DNA, 705 bp, Homo sapiens
  misc_feature: GYAE6OF02GI14U.38.38.D05.1.454.CMB.1.raw
  modified_base (228)..(228): a, c, t, g, unknown or other
  misc_feature (228)..(228): n is a, c, g, or t
  modified_base (499)..(499): a, c, t, g, unknown or other
  misc_feature (499)..(499): n is a, c, g, or t
  modified_base (644)..(644): a, c, t, g, unknown or other
  misc_feature (644)..(644): n is a, c, g, or t
tcagtcgatcacgtcacgaccggtgctcgatttagtatctgatagttgggtttgggggctttgcctgggctctgctgctcctcaccctcctcactcagggcacgagggtcctgggcccagtctgccctgactcagcctgcctccgtgtctgggtctcctggactgtacgatcaccagtcctcctgacacgtggaagcagtcgtgaactgtttgggtagttaataactnttgtcctcctaggtaaccaaacaacgacccaggacctaaaaccgcccctaaactcacttactaagtttatacggtactccactcacgttcccggcccgttacgttacggggttttcctacgtccgttccgtttccgtcgtcggtacctaccggttaagttcgacctaaaccgccggtacccttcctacggtacttcttacggcggtacctacgacggtcgtaggaacggtggacgtacgtttagtttaacttttacgtcgtcttaccgtanattaaccgtacgacgtacgacgaccgtacctacccgttacccttagttaccgttacgtaccgacggttaccggaccgtagttaccccgtaccgttactaccggaccaacccgtaccgaaccggaccctaaaccctgtaccgtacnccttccggtccctaccctccggtactccgagttacgccggtaagcacgggtacgcgtacgg

SEQ ID NO: 281395 - DNA, 755 bp, Homo sapiens
  misc_feature: GYAE6OF02F85K4.38.38.D05.1.454.CMB.1.raw
  modified_base (174)..(174): a, c, t, g, unknown or other
  misc_feature (174)..(174): n is a, c, g, or t
tcagtcgatcacgtcacgaccggtgctcgatttagtatctgatagttgggtttgggggctttgcctgggctctgctgctcctcaccctctcactcagggcacagggtcctgggcccagtctgccctgactcagcctgcctccgtgtcgtgggtctcgtggacagtcgatcaccntctctgcacgtggaagcaggtagtgactagttgggtagttaatactatcgtctcctacggtaacccaacaaccaccgaggaccaaaccgccccaaatctatctaatttacgtcgtacgtctactctacgtccggtaccctagttacgggtttctacgtcgtctttcgtcgtcgtctacgtaggttcgacaacgtccgtacctcctacgtacttagttcgtcggacctcgtacggcgtacggaggaaccgcgggttacttaacggtttatttacggttccgtccttacccgttaactaaggttaaaccgtaaccgggtaggtaccgtacggaccgtaaccggtacccctttaaccgttagtccggtttacgttaacccgggaaacggttaccgggtaaccgtaacggttacccgtacccggttacgtaaccggtacgaacccggtaaccccgtaaccgaacccctaaccctacgtcctaaccgtccttacccggtttaacctcccccttaacccgttcccgtacgtttacccggtaggtacccttaaccgggacggtacggtacccggggtcggtacccggg

SEQ ID NO: 281396 - DNA, 809 bp, Homo sapiens
  misc_feature: GYAE6OF02FZMYQ.38.38.D05.1.454.CMB.1.raw
  modified_base (164)..(164): a, c, t, g, unknown or other
  misc_feature (164)..(164): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctcgccctgactcagcctgcctccgtgtctgggtctcctggacngtcgatccaccatctcctgcacgtggacgctagtagtgactagtttgggtagttataactgtgtcctcgtacgaaccaacaaccgaccagaccaaccacccctaatcattactatttacgacgtaccgtacctactacgtacgtccccggtacccgttacggttacgggtttacctacgttccgtaccgtttccgtcggtacggtaccttaccgtaggttccgaccgaacgtacccgtccctaccgtacgtaccttacggttcggaccggtccgtaccgtacggtccggtaggacggtacgggtacgtcgtttaacgttataacctttacggcgtaaccgtacggtaccctttaacgtaacttaacgttaaaccgaggtacctaaacggtaccttaaggttaccggttaacggggtttccgggggttaacgggttacccgggggaaccgggttaaccaccgggttaccgtaaccgtacccggtttccgggtacggtaacctacggggtaacccccgacgttcccgtaccccggttcccggttacggtaccctacgggtttcccgttccccgttaccccgtcccgtaacccgttccggtaacggttccggtaccgtaccgggttacggttccgggacggtaccggg

SEQ ID NO: 281397 - DNA, 682 bp, Homo sapiens
  misc_feature: GYAE6OF02HS8ZW.38.38.D05.1.454.CMB.1.raw
  modified_base (147)..(147): a, c, t, g, unknown or other
  misc_feature (147)..(147): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
tcagtcgatcacgtcacgaccggtgctcgatttagtatctgatagttgggttggggctttgcctgggctctgctgctcctcaccctcctcactcagggcacagggtcctgggcccagtctgccctgactcagcctgcctccgtgtcngggtctcctggacagtcgatcaccatctcctagcactggaagcagtagtgacattgggtgttaataacctatgtctcctggttaaccaacgaacacccaggcaaacgtcccaaaactcatcattatgacgtacactcatcggccctcagggtttctactcgcttcgtactggcttcgaacggttttcgacaacgtaccggcttaccctagtaccgaacttttcgcggtcttacccgaaggtcgtaggaagggacgacgggtntaggttaattttacgtcgtcgttcccgtaanactaacgttaccgaaggtacaacgcctaacgtccgtaaaccccgtttagtaccgttacgttaaccggtaaacggtacgggttaaccaaaccgggtccttaacccgggttactaacccgttacgtaaccgtacccggaaaccggtccaaaccccgtatacgtccaacctttaccggtcgtttaccccggcccttaccgtcgtaccgtcgtacttacccggagtaccggtacggcgtaaccggg

SEQ ID NO: 281398 - DNA, 670 bp, Homo sapiens
  misc_feature: GYAE6OF02IYCVN.38.38.D05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagngacattggtgttataactatcgtctccgtacggtaaccaaacaaccacccgaaggaccaaaacgcccccaaaactcactactagttatgacgtccactcatccgcctcgtagggttctcgtcgtcttctcgtgcctacgtagtttcggacaacgtaccggccctaccgtacgtacctattacgtcggacctccgaggtcgtaggacgggacgtaggtctaaggttaacttttttatcgtccttcctataacgttactacgtagactacgactacgaccttacccttagttcgttaccgttacgaacgtacgggtaaccgtacggtaccctaccgtaccgtacgtaccgacgaaccccgtaacgaccccaaaccgtccgtactccgtaaccttccgttaaccgtttcccccaacccttccgttaacccgtacggtacgtaccgttaccggaccgtacgtacgggtacccgtcgg

SEQ ID NO: 281399 - DNA, 813 bp, Homo sapiens
  misc_feature: GYAE6OF02G62EE.38.38.D05.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
tcagtcgatcacgtcacgaccggtgctcgatttagtatctgatagttggggtttgggggctttgcctgggctctgctgctccctcaccctcctcactcagggcacagggtcctgggcccagtctgccctgactcagcctgccctccgtgtctgggtctcctggacagtcgatccaccatcctcctgcactggaancagtagtnacattggtgttataactatgtctcctggtaaccaaacaacacccaggacaaacgtccccaaaactcatctaatttatcgacgtacactccacgtccggccctagtacgggtttcctacgtcgtcttcctcgtacggtccttacgtaagtttcggaacctaacgaccggtacctccctgtaccctagtttccgtacgggtacctccctaagggtcctagggaaaccggtaaccggtagtacgttaacggtaatttttttacgtcggtacctacccgtttactaaattaacgtaacccgtaagccgtaacgtacccgtaaccggtcccctaaacccccttttaaggttcggtttaacccgtttaacggggtaaaacccgtaccggggtaaacccgttaaacggggtacccgtaaccccggtttacccgtaaacggttaccgtaacccgacccgtaaaacccgaaccccgtaaaacccccgtcgttaacggtcccctaaccgtttacccgtttacccgtaccccccgttaccccttaaccccgttccgtaaccggttttacccgaccgtttaacccgggtaccttacggggtaaccgggtccccggggtacgg

SEQ ID NO: 281400 - DNA, 692 bp, Homo sapiens
  misc_feature: GYAE6OF02H29CI.38.38.D05.1.454.CMB.1.raw
tcagtcgatcacgtcacgaccggtgctcgatttagtatctgatagttgggtttgggggctttgcctgggctctgctgctcctcaccctctcactcagggcacagggtcctgggcccagtctgccctgactcagcctgccctccgtgtcgtgggtctccgtggacagtcgatcaccatctcctgccacgtaggaagctaggtagtgactagtttgggttagttaataacttgtcgtccttaccgtacggtaaacccaaacgaaccgacccgaggaccaaaaccggtcccctaaactcacttactaatttatcggtactctactcacgtccggtcccttacggtacggttttctaccgtcgtcttcgtcgtcgtcctacgtagttcgactacgcgtccctcgtacacgttcttacgcgtcctcgacgtcgtagacggtacggtacgcttagtacttttagtctcgtactatatacgtacgagacgtacacgtactacccttacttacgtgttaccggtacgtaccggacggtaactaccggtacctaaccggtcccttagcccgtaacacccggaaacccgccctaaccgtaccgtacctaccgttaccgttacccgtttcccggtccccttacccgtaacccgtactaccggtacgtaccggttccggacggtacggtccggtccggtacggg

SEQ ID NO: 281401 - DNA, 867 bp, Homo sapiens
  misc_feature: GYAE6OF02HF2J5.38.38.D05.1.454.CMB.1.raw
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
tcagtcgatcacgtcacgaccggtgctcgatttagtatctgatagttgggtttgggggctttgcctgggctctgctgctcctcaccctcctcactcacgggcacagggtcctgggcccagtcctggccctgactcagcctgcctccgtgtctgggtcctcctggactagtccgatccacctntcctcctgccactaggaanccaagtgtgacagtttgggtagttaatactagttcgtcctccgtacggtaacccaaacgaaccctacccgaagggaaccaaaaccgaccccccgtaaacttccaacttacgtaactttacgtacgtaccgtcctaaccgtccacggttccggtccccttacggttaagggtttccttaccgtccgttccgtttcctccgtacggtccttacggtaacggtttcgaacctaccgacccggtccccttacccgtagtaacccttcgtttaccggtaccggccttacccggtagggtaccgttagggaaccgggtaacggtaccggtctttaacgggtttaaacctttttacgttaacccgttcccctttaaccgtaaacgtaaccgttaaaccgggacgggtccctaaacggtacccggtaaccggtacccccttaaccccgtttaaggttccccggttttaccggttaacccgttacggtaccgggtaacccgtaacggtacccgtacccgttaccgtccgtaacgacccgtacccgaaccgtaccccgtaaccctaaccgtcgttaaccacccgtttccgtcccgttaaccccctcccgttaccctaacggtaccggtactaaccgtacccggtagttacccggaccgggttcggaccgtaacggg

SEQ ID NO: 281402 - DNA, 878 bp, Homo sapiens
  misc_feature: GYAE6OF02IXUFE.38.38.D05.1.454.CMB.1.raw
  modified_base (195)..(195): a, c, t, g, unknown or other
  misc_feature (195)..(195): n is a, c, g, or t
  modified_base (599)..(599): a, c, t, g, unknown or other
  misc_feature (599)..(599): n is a, c, g, or t
tcagtcgatcacgtcacgaccggtgctcgatttagtatctgatagttggggtttgggggctttgcctgggctctgctgctcctcaccctcctcactcagggcacagggtcctgggcccagtctgccctgactcagcctgcctccggtgtcgtgggtctctggacagtcgatcacctatcctctgacactggaacnctagtagtgacgtagttggtagttaactaactattgtactccgtacggtaaccaacaaccgtacccgaacggacaaaacccgaccccaaattcaacttccgttaattttacgtcgtaaccgttctaaccgttaccgacgttcccggacccctttacgggtacggggttttcctaaccgttccgtcctttccggtcgtaccgggtccttacccgttaagggttaccggaactaaccgtcccgggtacccttcccgtaaggtacccctttacggtttaccgtacgggtcccgttaccgtacgggttccggtaagggaccggggaaccgtacggtacgtttaaacgttttaacgtttttagttacccgtacctttacccgtaacgtaaacgttaccgttaaaccggnggttaacccgtaagcccggttaacctaaccccgttacccgtttttaacgccggttttaccccgggttaagggtaacccggttccggggtaaaccacccggttacccggtaacccgttcgttaaaccccgggccgtaaccggaaccccgggtaaaccgtccccccgtaaaaccgtcttacggtacccctacttttcccggtaacccctttccccgtaaacccggtcccttacggtaataccggtcgttaaccggtaggtccgtaccgggtcgggttaacg

SEQ ID NO: 281403 - DNA, 718 bp, Homo sapiens
  misc_feature: GYAE6OF02HZE3P.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactgggaagcaggtagtcgactagttggttggttaataacttatgtctctggtaaccaacacacccgaggaccaaacgccccaaactcatactattatgacgtcactcactccggtccctcgtacggggttttcctacgttccggtctttcgtcgttcggaccttaccgtaagtttcggaccgaaccgtacggccccttcccgttacggaacccttacgttttccgttcgggtcctacccgtacggccgttaggaacgggtacgagggtaccgttagtttaaacgtttttattcgtacccttaccgtctaagttaacgtaacgacggactacgcgtaccgacccttaacccgttattacgttaccgttacggaccgtacgggaacctaacggtaccgtacccgttacctaccgtacgaccgtacccgaacgtacccctaacctccgtaccttacgtcctacgtcccgttaccccgtacccctcccgttacccgacgtacgtaccgtaccgtaccgtacggtccggacggtaccggg

SEQ ID NO: 281404 - DNA, 735 bp, Homo sapiens
  misc_feature: GYAE6OF02G6HE2.38.38.D05.1.454.CMB.1.raw
  modified_base (135)..(135): a, c, t, g, unknown or other
  misc_feature (135)..(135): n is a, c, g, or t
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
  modified_base (321)..(321): a, c, t, g, unknown or other
  misc_feature (321)..(321): n is a, c, g, or t
tcagtcgatcacgtcacgaccggtgctcgatttagtatctgataggttggggtttgggggctttgcctgggctctgctgctcctcaccctcctcactcagggcacagggtcctggcccagtctgccctgactcgngcctgcctccgtgtcctgggtctccgtaggacaggtcatcacccattcctccgtaggactaccgtagggaancgtaaggtagtgaacttagttggtacgttataaactgtcgtctacgtacgaaccaanaccgtaccgagacaaaccacccaactcgactctaattacgacgactactacgtaccncggtccgaccgtacggtaccgggttactactaccgttccgtctttacggaccgttcggtaccttaaccgtaacgtttacggaccgtaaccgtaccggtccttacccgttacaacccgttacgttttggaccggtacctacggacgtaccggtaggaaccgggtaacgtaccggtacttagggtttaaacctttgtaccgtctataccgtaattaagtacgacgactacggacgactaaccgttacccttagttcgtacgtaacgggtaactacggaccgtaaacgtcctacggtacctacgacgaaccggtacaaccgaccgtaaccctgtacccgtactacccttataccccggttccctacccttacgtccgttaacggtcacccggtaagtaaccgtcggaccgttacggg

SEQ ID NO: 281405 - DNA, 733 bp, Homo sapiens
  misc_feature: GYAE6OF02GIZ8R.38.38.D05.1.454.CMB.1.raw
  modified_base (188)..(188): a, c, t, g, unknown or other
  misc_feature (188)..(188): n is a, c, g, or t
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctcgtgtctgggtctcctggacagtcgatcaccatctcctgcactggaancaaggtagtcgactatttgggtagttaataactatgtactaccgtaggtaaccaacgtaaccacccgaggaccaaaacgtcccccaaactcgactcgtaatttagtcggtactcactcgactccggccctcgtacgggtttctacgtcgtctttctcgtcggtctaccgtaggtttcggaccaacgaccggtcccttcccgtacgtacctatttccggtggtccttaccgacggtcgtaggaacggtacggtacggtacgttagttaaacgtttttgtacgtccttacctacgtaattaacacgtaggaccaggtactaccgtacccgtaccttaagtcgttaccgtaacgtaacggtaccggaaaccgtaacgtccgtaacccgttaccgttaccggacgtaaccggaaccctaaaccggaaccccctaacccgtaccggtttactaccctaacccgtttcgttaaccccgttaccccgtaccctcccggttacctaccgttcggaacccttcggaacgtaccggtaccggttccggtaaccgg

SEQ ID NO: 281406 - DNA, 816 bp, Homo sapiens
  misc_feature: GYAE6OF02GFPQZ.38.38.D05.1.454.CMB.1.raw
tcagtcgatcacgtcacgaccggtgctcgattttagtatctgatagttggggtttgggggctttgcctgggctctgctgctccctcaccctcctcactcgagggcacagggtcctgggcccagtctgccctgactcacgcctgcctccgtgtctggtactcctggacagtcgatccaccactctcctcgctactagggacgactaaggtagtgaactagtttgggttacggttaattaactagtcgtacctccgtacggtaaccaaacctaaccgacccgaagaaccaaaaccggacccctaaaacctatactaacttaacgttttaagtagtaccgtacctaacgtctaacgtccggtaccccgttacggtagggttttccacttccgttcttccttacgccggttactaccgttaaggtttcgacgaaaccgtcggtccccttaccgtactaaccgtttattcggacgggtcctacaacgggtctagggtaaacggaccggtaacggtcttaagtttaacgttttcgtttacgtcccgttactacctaagttaacgtaaccgtacggcgtaaactagaaccgtaccccgttaaccttacgttacgttacgttaaccgttaggtaacggaaccgtaacggttaccctacggtacccgttaagtacccgtaacgaaaccgaacccggtaccccaaacccgtaccgtttaccgtacgtaccgtttacccgtaacccggttccccttaacccggtcccttacggtacccgttagtaacccgttacccggtaacggtacggtaccgggacccgggttac

SEQ ID NO: 281407 - DNA, 745 bp, Homo sapiens
  misc_feature: GYAE6OF02GKDSI.38.38.D05.1.454.CMB.1.raw
  modified_base (132)..(132): a, c, t, g, unknown or other
  misc_feature (132)..(132): n is a, c, g, or t
  modified_base (287)..(287): a, c, t, g, unknown or other
  misc_feature (287)..(287): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactnagcctgcctccgtgtctgggtctcctggacagtcgatccaccatctcctgcacgtggaagcagtagtgactgttggtgttaataacctatcgtaccttccgtacggtaaccaacaaccacccgaggacaaaccgccccaaacgtcatctatttangtacgtcactcactcggccctcgtacgggtttctactcggtccttccgtcgtcggcgttacctaaggttttcgacaacgaccggtccctccgtacgtacctagtttcgcggtcctaccggtacggtctacgggaacggaacgtacggtcgtacgtttaaagtttttcttacggtcctacctacgtacttagtaaccgtaggtctaacggtccgaccgtacccgttacccttagtaccgttttacgtaacgggtaccgttccggggtaaaccgtacgggttacccgttaacccggttacccgttaacgtccgaacccgtacccgaaacccggtccctaaaacccgtcgttacgtacccgtaccctttccggttacccgttacccccgttcccgtacccgttaacccggtacggtacgtacccggttaccgtacggtcgggtaccggccggtaacccggg

SEQ ID NO: 281408 - DNA, 944 bp, Homo sapiens
  misc_feature: GYAE6OF02FVWYS.38.38.D05.1.454.CMB.1.raw
  modified_base (157)..(157): a, c, t, g, unknown or other
  misc_feature (157)..(157): n is a, c, g, or t
  modified_base (201)..(201): a, c, t, g, unknown or other
  misc_feature (201)..(201): n is a, c, g, or t
tcagtcgatcacgtcacgaccggtgctcgatttagtatctgatagttggggtttgggggctttgcctgggctctgctgctcctcaccctcctcactcagggcacaggggtcctggggccctagtcgccgcctgacctacgacgtctcgtcctcggtntcggtcggtcctcgtaggactgtacgactaccacctcttcctcncgactacgaggacgacgtaggtagtacgaacgttaggttgggtttaagttaacttaacgttgttccgttacccgtcggttaaccgaacccaaaaccgtaaccccaccggaacggaaaccgtaaaccccgaacccctaaactcctaactactttaaattttacgaccgggttaacttcctaaccttctaaccggttccccggtaccttacggggttttacggggtttacccttaccggtccgttttaccttccggtggttcccggtacccgttaaccgggtttaacgggtttccgaaacccggtaaacccggttaccccggtccccgttacccgtaacgttaccttttaacggtttccgggtccgggtacccctaccgggacggttcgtaacgggaccggggtaacgggtcgtttaacggtttaagttttaaacgttttcgtccgtccctttacgtaactagttaaccgacggtaagaccgtaacgaccggtaccctacccgttaacctttcggttaccgttaccggttaaaccggacgggtttaccggaaacggtacccgtaaccttacccggtacccgtacgtaccgggaaccgttaaccccggaaccgtacccccttaaaccgtcggttaccgtacccgttaaccctttccggttaaccccctccccgttaaccccgttacggtaccccttaggacccttaccgtccggtaacggcgggttaaccgggccgttacccgggg

SEQ ID NO: 281409 - DNA, 551 bp, Homo sapiens
  misc_feature: GYAE6OF02GMPRS.38.38.D05.1.454.CMB.1.raw
  modified_base (434)..(434): a, c, t, g, unknown or other
  misc_feature (434)..(434): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattgggtggttataactatgtctcctggtaccaacaacacccaggcaaagccccaaactcatcatttatgacgtcaactcatcggccctcaggggtttctactcgcttctctggctcaagtttgtcaacaccggcctccctgaccattttcgtgggtctccgaggcttagacgggaccggaggcctgtaaatttttattgctcctacatactacaggcagcagcctacccttancgtacttcggaactgggaccaaggtcaccgttcctacgtcagcccgaaggacccaacccactctacacctactcgttaccccacccgtcctccacgtcgatccgactgagcggtacg

SEQ ID NO: 281410 - DNA, 666 bp, Homo sapiens
  misc_feature: GYAE6OF02FO00Z.38.38.D05.1.454.CMB.1.raw
  modified_base (191)..(191): a, c, t, g, unknown or other
  misc_feature (191)..(191): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactgggaancagtagtgacagtttggtggtttataactatgtcctcctggtaacccaacaacacccaggacaaacgccccaaatcgatcaatttangtacgtcactcatcgcctnagggtttctactcgcttctctggctcagttcgcaactccggacctcctcgacctattacgtggcctcaggctaggacggngagcttgtaacttttagtcgtcctccgttcaattaacgtaacgtagtacgagtacctacgggacccttaacccggtttataccggtttaccgtttaaccggtaaccggttacggggaaacccgtaacgggttacccgtaacccggttaccctacgggttaccaccgacccgtaaacggtaccccaaacccgtacgtcccgttacctaaccgtcctttaccggtccccctaccgttccccgtcccgttagtccgtaccggtaccgttcggacggttcgggaccgtacggg

SEQ ID NO: 281411 - DNA, 784 bp, Homo sapiens
  misc_feature: GYAE6OF02HXDXL.38.38.D05.1.454.CMB.1.raw
  modified_base (447)..(447): a, c, t, g, unknown or other
  misc_feature (447)..(447): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttgggtaggttaataactattgtacctccgtacggtaacccaaacgaaccacccgaggaccaaaaccgacccccaaactccaattctattagtagaccgtcacctacgacgtccggacccttcggtacggggtttctacgttccgtctttccgtcgttcggtaccttaccgtaacggttttcggaccaaccgacccggtcccgttaccctcgtaacctgttttaccggtcgggtccttaccggnggtccgtagggacgggtacgggtacggtacgtttaagtttaacgtttttacttcgccgtttccctacttaacgttacttaaccggacggtacctaacggacctaccgtaccctaaccccgtttacgtagtttaccggttaccgggtaacgtacccgggtaaccggttaacggtccccgtaaccgttacccgttaacgacccgaaccgaccccgaaacccggtaccccaaacccccgtagtaccgtacccgttcctcccgttcccggtttcccccgtaccctttccctaccggaccgttcgtaccgttacggaccgttacggtacgggaccggtccgg

SEQ ID NO: 281412 - DNA, 868 bp, Homo sapiens
  misc_feature: GYAE6OF02HKUO4.38.38.D05.1.454.CMB.1.raw
  modified_base (195)..(195): a, c, t, g, unknown or other
  misc_feature (195)..(195): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcaggcctgccgtccgtgtctggggtcctcgtggacagtcgatcacactctctgcagtggaacgnagtagtgactagttggtggttataaactgtcgtccttccgtacggtaaccaaactaaaccgacccgaacgggaaccaaaaccgaccccctaaactacctaacttactaagttttacgtacgaccgttacctaactccgtaacgtcccggtaccccgttaggttaccggggtttacctaccgttccgtacctttccgtcgttccggtaccgttaccggtaacggtttcggacccgtaaaccgtcccggtcccgttaccccgtacgtaccgttaacgtttcggtaccgggtaccttacccggaggtcggtaacggtaccgggtaacggtacgttcccgtagttttaacgttttccgttacggtccctttcctaacaacgtaacgtacgtaacggtcaacggtaccacccgtaacccttacccgtttacgtaccggttaccgttaccggaaccgttaccgggtaaccgtaccgggttaccgtaaccttcccggtaacgacccgtacccggaaccgggttaccccaaaccccggtaaccgttacccgttacgttacccgtaaccctttacccgggttttcccccgtacccccttacccggtttacccgaaccccggtttaactcggtttaaccggtaccccggccgtaacgggggttacggaccccgggttaacggg

SEQ ID NO: 281413 - DNA, 758 bp, Homo sapiens
  misc_feature: GYAE6OF02HV1TU.38.38.D05.1.454.CMB.1.raw
  modified_base (133)..(133): a, c, t, g, unknown or other
  misc_feature (133)..(133): n is a, c, g, or t
tcagtcgatcacgtcacgaccggtgctcgatttagtatctgatagttgggtttgggggctttgcctggactctgctgctcctcaccctcctcactcagggcacgagggtcctgggcccagtctgccctgactnagcctgcctccgtgtctgggtctctggactgtcgatcaccatctcctgcacgtggaagcgtagtagtcgactagttgggttcggttaataactagttggtcctccgtaggtaacccaaactaaccaccgaggaccaaaaccgacccccaaattaccattactattatacgacgtcactcactccggcccgtcgttacgggtttacctctccggtcttactccgtggtccttacgtagtttcggactaacgtacccggtcctaccgtggtaacccttgttccgtcgggtacctacgacggtacgttacggacgggtaacgtacggaccgttagtttaaagttttcgttactcctacccgtaactaactttacgtaacggacggtaccgaacgaccgtaacggtaacccttacccgtttaagtttcggttccgtttaacggaaccgtaggggaaaccccttaagggttccctacccggttccgtaccgtaccggtaccgaaaccccgaaacgggtaccccaacccggtaacttccgtaccgtaccgtttaccgtcccggttcccctaccccgttccgaccgttaccgtacggtaccgtaccggacgttacggtcgggtccgtacggg

SEQ ID NO: 281414 - DNA, 794 bp, Homo sapiens
  misc_feature: GYAE6OF02HQ7LN.38.38.D05.1.454.CMB.1.raw
  modified_base (192)..(192): a, c, t, g, unknown or other
  misc_feature (192)..(192): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctctggacagtcgatcaccatctcctgacacgtgggaanctaggtagtagactagttgggtagttaataactatcgtcctcgtaggtaaccaaacacctaccgaggacctaaaaccgcccctaaatcatactaatttagtacgtaccgtaccaactctacgtccggtacccttacggtacgggttttacctacgttccggtctttccgtacgttcggtaccttaccggttaaggtttccggacctaaccgtaccggtcccttacccgtacgaccctttagttccgtcgggtacctaccgtacggacgtacgggtaacgggtaacggtacggtaacgttagtttaaacgtttttcgtcgtaccgttcctaactaaacgtttacgaaccgacggtacacgaccgtaacggtaccccttaaccgttgttaccgttccggttaccgaaaccggttaccggaacccgtaggtaccccgttaacccgttacccgtaccgacccggtaaccgtaacccggtaaaccccggacccctaaaaccgtcgttaccgtacccgttaccttaccgtcccgttaacccccgacttacccggttacgtaccgttacgtacggtaccgtaacgggttacgggccggttacggtacgg

SEQ ID NO: 281415 - DNA, 823 bp, Homo sapiens
  misc_feature: GYAE6OF02I4YHR.38.38.D05.1.454.CMB.1.raw
  modified_base (172)..(172): a, c, t, g, unknown or other
  misc_feature (172)..(172): n is a, c, g, or t
tcagtcgatcacgtcacgaccggtgctcgatttagtatctgatagttgggtttgggggctttgcctgggctctgctgctcctcaccctctcactcagggcacagggtcctgggcccagttctcgccctcgactcagcctgcctcgtgtcgtcggtctcgtgacagtacgacncacactctctcgctacgtagacgactagtagacacgtagttgggtagttaactaacttgtcgttccgttaccgtacggtaaccaaaccaaccctaccgaacgtaaccgaaaccccaaccccaaacctcgtattacttaacttttacgacgtccgtacctaccgtacctaccgttccccggccgtttccggttaacgggtttaccttaccgttccgtcctttccgtgtcccggttacctaccgtttaggttaccggacctaaccggtccccggtaccccttacctacccgttaactttacccgttcggttacccgtccgtaccgtcgtacgtgggaacgggtacgtcggtagttaacttttaagtttcttccggtctttaccaacgttataaccggttaacgcggaccacggacctaaccgtaccccgtttaaccgttaattttccggtaccggtaacggaacggggttaccgaaaccggtaccgttacccgtaccgttcccgaactacccggtaccggaccccgggaacccctaaccccgaccgtttaccacccgttacttacccgttacccgtccccggttaacccctcccgtacccgttacgtaccgtacccgtcgtaaccccggtaggtccggaccggttacggcggg

SEQ ID NO: 281416 - DNA, 754 bp, Homo sapiens
  misc_feature: GYAE6OF02HPQH6.38.38.D05.1.454.CMB.1.raw
  modified_base (298)..(298): a, c, t, g, unknown or other
  misc_feature (298)..(298): n is a, c, g, or t
  modified_base (452)..(452): a, c, t, g, unknown or other
  misc_feature (452)..(452): n is a, c, g, or t
tcagtcgatcacgtcacgaccggtgctcgatttagtatctgatagttggggtttgggggctttgcctgggctctgctgctcctcaccctctcactcagggcacagggtcctgggcccagtctgccctgactcagcctgcctccgtgtcgtgggtctccgtgacagtcgatccacctatcctcctgactactggaacgcagtagtagactagttgggtagttaacaactagtcgtctacgtagtaacccaaacgaaccaccgagaccaaaacccgccccaaactctactactaatttanacgacgtcactcacgtccgacccttacgtacgggtttctacgttccgtcttctcgtcgcctacgtacgttcgactaaccgccgtcctcctacgtactattcggcggtcctacgtacgcgtaggacggacgtacggtacttagttaaacgttttntccgtcgtttaacctacgtaacttacgtaacggacgtacgtaacgtcgtaacgttccctaaccgtttcgttacgttaccgtttaaccgggaaacggttaccgggtaaaccgtaacggttccccgaccccggtttaaccgtacccgaccgtaacccggtacccgaaacccggtaccccctaaaccgttacccgtacgtttaccctaccggttacctttaacccggtcccccttaccctacccggttacgtaaccgtacttaccgtacggttaacccgaacgggttccggtaccggtacccggg

SEQ ID NO: 281417 - DNA, 686 bp, Homo sapiens
  misc_feature: GYAE6OF02GN6MM.38.38.D05.1.454.CMB.1.raw
  modified_base (502)..(502): a, c, t, g, unknown or other
  misc_feature (502)..(502): n is a, c, g, or t
  modified_base (545)..(545): a, c, t, g, unknown or other
  misc_feature (545)..(545): n is a, c, g, or t
  modified_base (620)..(620): a, c, t, g, unknown or other
  misc_feature (620)..(620): n is a, c, g, or t
  modified_base (657)..(657): a, c, t, g, unknown or other
  misc_feature (657)..(657): n is a, c, g, or t
  modified_base (666)..(666): a, c, t, g, unknown or other
  misc_feature (666)..(666): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctccgtggacagtcgatcaccatcctcctgcacgtggaagcaggttagtcggaactacgtttgggtaggtttaactaaccttagtcggttccttacccgtcgggtaaacccaaaccaaccgaccccgaaggtacccaaaaccggtacccccaaaactccgaactacctaaattttagtacgggtaccgttccgaacctcctacgttcccggtccccttacggtacgggggttttacctaccgttcgtcctttcctcgtcggtcctaccgtaaggttcggacaaccgtcgtccctccgtcgtacctattcgcggtcctcgacgctaggacgcgagtctagttaacttttntccgtcttcctacgtatactacgagcagcacgtacctacgttntcgtcgtacgacgtacggaactacgtcctaccgtctaccgtacgaccgtaccgaccgaacccaccacgtctaccncttccgtcccgttcccgccctccgtccgtacgtaccncgtacccgngtaggtaccgcggttaaccg

SEQ ID NO: 281418 - DNA, 358 bp, Homo sapiens
  misc_feature: GYAE6OF02H6UFH.38.38.D05.1.454.CMB.1.raw
  modified_base (164)..(164): a, c, t, g, unknown or other
  misc_feature (164)..(164): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (307)..(309): a, c, t, g, unknown or other
  misc_feature (307)..(309): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (320)..(358): a, c, t, g, unknown or other
  misc_feature (320)..(358): n is a, c, g, or t
tcagtcgatcacgtcacgaccggtgctcgatttagtatctgatagttgggtttggggtttctactcgcttctctggctccaagtttggcaacacggcctccctgaccatttctgggctccaggctgaggacgaggctgaatttttatgctcctcatatacaggnagcagccaccccttatgtcttcggaactgggccaaggtcaccgtctacgtcagcccaaggcccaacccatgtccacttctcgttccccgccctctcacgtnatccgactgaggccgggntggcctaaggcgcaatagcatcannnctgntangctnnnnnnnnnnnnnnnnnnnnnnnnnnnnnnnnnnnnnnn

SEQ ID NO: 281419 - DNA, 464 bp, Homo sapiens
  misc_feature: GYAE6OF02HMJGC.38.38.D05.1.454.CMB.1.raw
  modified_base (107)..(107): a, c, t, g, unknown or other
  misc_feature (107)..(107): n is a, c, g, or t
  modified_base (118)..(118): a, c, t, g, unknown or other
  misc_feature (118)..(118): n is a, c, g, or t
  modified_base (157)..(157): a, c, t, g, unknown or other
  misc_feature (157)..(157): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (410)..(464): a, c, t, g, unknown or other
  misc_feature (410)..(464): n is a, c, g, or t
tcagtcgatcacgtcacgaccggtgctcgatttagtatctgatagttgggtttgggaacctatgaacattctgtaggggccactgtcttctccacggtgctcccttntactcgcttcnctggctccaagttgcaacacggcctcctgaccattttcngggctaccagctgaggcgaggctgtaattttagtgcctcctanatatacgaggcagcagcctacccttangttctacgaacgtcgggaaccaaggtccacccgttctaacggcacgcccaacggacccaaaacccctctcgtacaccttcgtcgttcccccccgttacctccgacgtcgtaactccggtactagcggccgggtccttagggaaaccgtgggaccccgtgaaacgttggcagcttaagcattannnnnnnnnnnnnnnnnnnnnnnnnnnnnnnnnnnnnnnnnnnnnnnnnnnnnnn

SEQ ID NO: 281420 - DNA, 561 bp, Homo sapiens
  misc_feature: GYAE6OF02GI5E5.38.38.D05.1.454.CMB.1.raw
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
  modified_base (494)..(494): a, c, t, g, unknown or other
  misc_feature (494)..(494): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtggttataactatgtctcctaggtaccaacaacacccaggacaaacgccccaaactcatcatttatgacgtcactcactcggccctcgaggggtttcctactcgcttctctggctcagttcgctaacncggcctcctacgacctattcngggctccgaggctggacggacgaggtctgtaattttntcgctacctnattatacgagcagcacgcctacccttntcgtacgttcgacgtgggaacctacgggtccaccgttccacgtcacgacccgacgacccaacccnctcgctacctcttccgtaccctccctaccttccgtaacgtcgtactccggactcggacgcgggtccg

SEQ ID NO: 281421 - DNA, 899 bp, Homo sapiens
  misc_feature: GYAE6OF02IFC84.38.38.D05.1.454.CMB.1.raw
  modified_base (223)..(223): a, c, t, g, unknown or other
  misc_feature (223)..(223): n is a, c, g, or t
tcagtcgatcacgtcacgaccggtgctcgatttagtatctgatagttgggtttggggctttgcctgggctctgctgctcctcaccctcctcactcgagggcacgacgggtcctgggccctagtcctcgaccctgacctcagcctcgcccttccgtgtcgtcgggttcctaccgtggacagttcgatccaaccattcctcctagcctaagtggaatcaggtagngactaggtttaggttaggtaaattaacctgttcgttcgttacccaacggtaaacccaaaacgaacccgtaaccgaaggtaacccaaaaaccggacccccttaaaagtccttaattacttaattttacgaacggtccgtaacgtacttaaccgtacgtaccccggtaccggttaccggttacggggttttacccttaccggttaccgtccttaccgttccggtaagtcccgttaaccggttaacgtttaccgaaccggtaacctaaccccgggtcccgttaacccctacgtaccctttacggttttaacccgggcggtaacccgtaccggtacgtacggtaacgggaaacggtagggtacggtaccgttagttttaaacgttttcgtaccggttcctacgtaactaacgttaacgtaacgagaccgtataccgacgtaccgttaaccgttacgtacggttaccgtaccgtaacgtaccgggaaaccttaccggtaccgtacccgtacgtaccgttaaccgaaccgaacccggaaccccggtaaccctaacccgtattacccgtaaccttacccggttaacgtttcccccgggttaaacccgtccccgttaacctttaccggaccggtttaaccgacggtttaaccccgtacggtaacgggcgggttacgaacccggg

SEQ ID NO: 281422 - DNA, 862 bp, Homo sapiens
  misc_feature: GYAE6OF02IU35Y.38.38.D05.1.454.CMB.1.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcacatctcctgcactggaagcagtagtgactagttgggtagttataactatgtactcccgtaggtaaccaaaccaaccacccgaaggaccaaaccgacccccaaactccaattactaatttacgtcggtacgtacaccttcacgtcccggtacccgttcgtaaggggttttcctacttcggtctttaccttcgtacggtaccttaccgttaacggtttcggacctaaaccgtaccggtcccttcccgtacgtaccgttacttttccgtcggggttacctccgaggtcgttaggaaggggaccgtaacggggtctttaaggttaaatttttttaacgttcgttcccgtttacccttaacgtaactttacgttaaccgacgggtacgaacggacctaacccggtacccttaacccccggtttattaccgggtttacccgtttaaccggggaacccgtttaccgggggaaacccgtaacgggtttccccgtaaaccccggtttccgtaaaccggtaccgtaaaccggaacccgttaaaacccggacccccgttaaaacccccgtagtttaccggtacccttaaaccggttcccgtttacccggtttaccccccgtacccccgttacccgttacccggtaaccgttccgggtaaccttaccggtaaccgtaccgggggtacggtcccggggttacgg

SEQ ID NO: 281423 - DNA, 692 bp, Homo sapiens
  misc_feature: GYAE6OF02JAWHX.38.38.D05.1.454.CMB.1.raw
  modified_base (645)..(645): a, c, t, g, unknown or other
  misc_feature (645)..(645): n is a, c, g, or t
tcagtcgatcacgtcacgaccggtgctcgatttagtatctgatagttgggtttgggggctttgcctggggctctgctgctcctcaccctcctcactcagggcacagggtcctgggcccagtctgccctgactcagcctgcctcgtgtctgggtctcctggacagtcgatcaccatctcctgcacgtggaagcaggtagtgactagttgggtacggttaataactagttcgtcctccgttaggtaaccaaccaaccacccgaggaccaaaccgaccccaaactcactactaatttatacgacgtacacctactacgtccggtccccttacggtagggggttttcctacgttaccgtcttacgttccgtcggtcctaccgtaggttcggacaccgaccggtccctcctcgtacctacttttcggtcggtcctccgaggtcgtaggtaacgggacggtaggccttaagttaactttttagttcgtcctaccttacgtaattacgtaacgagaaccgacgacgactacccgtaccgtttactcggttccttaccgggacgtacgggaacgtacggtcctacccgtaccgtacgaccaccgacccgaccgtacccaacccgtctcgtacctcgttccgtcccgttccccncccgtaccctcgtacgtcgtactccggtacgtcggacggccggtcgg

SEQ ID NO: 281424 - DNA, 710 bp, Homo sapiens
  misc_feature: GYAE6OF02HLQCY.38.38.D05.1.454.CMB.1.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcacgcctgcctccgtgtctgggtctcctggacagtcgatcaccatctcctgcactggagcagtagngactagttggtagttataactntgttactccgtagtaaccaacaaccnccgaggacaaaccgaccccaatcatctattatcgacgtacctactcacgtccggacccgtgtacgggtttctacgttctacttctcgtcgtacctacgtagttcggactaccgccgtaccctccgttacgaccttacgtttccgtcgggacctcgacggtcgtagggacggtacgtaacggtcgttaagttaactttttacgttctcccttacgtactagtaacgtacgaacggactacggacctacgtccccttaacccgtttagtccggtacgttacgggacgtacggtaaccgagttccgtaacccgttccgaaccgtacgtacccgtaaaccccgtacggtaaccccacccttacgtcctacccgtaccgtttcccggttcccggtaccccctacccttacccggtccgttaaccggttcggacctaccggttaaccggtaggttcccgggacggtaccgg

SEQ ID NO: 281425 - DNA, 739 bp, Homo sapiens
  misc_feature: GYAE6OF02G22HM.38.38.D05.1.454.CMB.1.raw
  modified_base (196)..(196): a, c, t, g, unknown or other
  misc_feature (196)..(196): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctccgtggacagtcgatccacctatcctcctgacactggaacncaggtacgttgaactagtttgggtagtttaaataaaattagtcttccgttcgttacggtaaacccaacttactaccaaccgaaactactacccaacccgaggtaaccaaaccgttacccccaaaactcctaatttaagtttagtacgtacggtacaaaccgtaaccggtcctaacgtacggttatttactaactccgtcttccgttcgtacggtcctaccgtaagttccgacgggtacaaaccggtccgtcccctaccggtcgtaaccccgttatttcccctcgggtaccggtacctacccctaaccggtaacggtacggaacccgtcgtaccgtacttaaccttagtttacttctacgtaccgtctacgtactaactaacgtcgaacgtcgttaccgtgtaccgttgggtacgttcggaacgggtccgtacgcgtacgacggtttcacggtcgtcgtacccgagtcccgtccgtaccccgtcggtacctccgtaccgttcctccccgttaccttccgtacgttcgcgttacgtacggtaccg

SEQ ID NO: 281426 - DNA, 791 bp, Homo sapiens
  misc_feature: GYAE6OF02I5U2B.38.38.D05.1.454.CMB.1.raw
  modified_base (231)..(231): a, c, t, g, unknown or other
  misc_feature (231)..(231): n is a, c, g, or t
  modified_base (321)..(321): a, c, t, g, unknown or other
  misc_feature (321)..(321): n is a, c, g, or t
  modified_base (558)..(558): a, c, t, g, unknown or other
  misc_feature (558)..(558): n is a, c, g, or t
tcagtcgatcacgtcacgaccggtgctcgatttagtatctgatagttgggtttgggggctttgcctgggctctgctgctcctcaccctcctcactcagggcacgagggtcctgggcccagtctgccctgactcagcctgcctccgtgtctgggtctccgtggacagtcgatccaccatcctcctgcactagggaagctagtagtagactagttgggttggttaactaactntcgttctccgtacggtaacccaaacaaccacccgaggaccaaaccgccccctaaactctatactatttactcggacgtcactacgtaccnccggtcccgttacggtacggggtttaccttacgtccgtcttccgttcggtccgtcctacgttaacggttcgaccgaaccggtacccgtccctaccgtcgtacccttacgttttccggacggtccttaccggaggtcgtaggaacggggacgtggtacttaagtttacttttacgccgtccttaccgtactacttaaagtcgacggtacgacacggtaccgtacccttaacccggttntttccgggttaccgttaaccggggtaaccgtaccgggaacctaccggttacccgttaacccgttacccgttaacgccggtaaccgaccccggggaacctaccccgtaaacccgtccgtaccgttacgtaccctttccggttaccccttacccggtaccccttcccgtaacgtttaccccgggtaacgtacccggtacccggtaagtaccgggaccgggttcccggtacccggg

SEQ ID NO: 281427 - DNA, 788 bp, Homo sapiens
  misc_feature: GYAE6OF02INV9I.38.38.D05.1.454.CMB.1.raw
  modified_base (301)..(301): a, c, t, g, unknown or other
  misc_feature (301)..(301): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctcgcctccgtgtcgtgggtctcctggacagtcgatccaccatctcctgcacgtggaacgctagtagtgactagttggtagttaataactatcgttcctccgtaggtaacccaaacaaccgacccgaaggaaccaaaccgaccccaaactcaacttactaatttanacggtaacctaccgactacctacgtcccgggtaccctacggttacggggtttcctaccgtccgtctttcctcgtcggtaccttacgttaaggtttcggaacctaaaccggtaccggtcccttaccgtacgtaccgttatttccgggtcgggtcctaccgtaggcgttacgggaacgggtacggtaaggttccgttaagtttaacgttttttacgtccgtacccttaccgttactaaacttacggtaacgtacggtacgtacggacctacccggtaaccccttacccgttaagttaccggttaccgttaaccgggtaaccgtaaccgggaccgtaacgtacccgtcccgttaaccgtccgtacgacccgtaacccgaacggtacccaacccgtcgtacgtaccctacgttcccgtcccgttccccgcccttaccggtactaaccggtcgtaccggttacccggacgtacgggtccgggacggtaccgg

SEQ ID NO: 281428 - DNA, 634 bp, Homo sapiens
  misc_feature: GYAE6OF02J1UFS.38.38.D05.1.454.CMB.1.raw
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcacctatctcctgcactggaancagtagtgactattggtacttataaccatcgtctcctggtaccaacntacaccagacaacgccccaatcatattangacncagtagtcgcctgnggttcngatcgtctcgtcagcctaccagtcgtcgaacaacgccggtacctcccganaacctcttcgtcgtcggcctcgtaggtgacggagcggtctagacttagtacgtcgccgtcctacgactaggagtaacgttcgagggttacgggtttcggaccggtaacgggacctaaacgggtcgaacccgttacgtacggtcgaccgtaccgaacggtccgtacccgtcccgttacgggtccaaccgttccgttaccccgttacccgacccttacccgtacgtaccgttacgtacgtacccggttagtacccgggtacgggtacccggtcggtacggaccggtaggaacccg

SEQ ID NO: 281429 - DNA, 705 bp, Homo sapiens
  misc_feature: GYAE6OF02H1532.38.38.D05.1.454.CMB.1.raw
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (672)..(673): a, c, t, g, unknown or other
  misc_feature (672)..(673): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
  modified_base (691)..(691): a, c, t, g, unknown or other
  misc_feature (691)..(691): n is a, c, g, or t
tcagtcgatcacgtcacgaccggtgctcgatttagtatctgatagttgagtttgggggctttgtctgggtctcctggacagtcgatcaccatctcctgcactggaagcagtagtgacattggtggttataactatgtctccgtggtacaacaacaccaggcaaagcccccaaatcatcatttatgactcactcatccggcctacgtaggggtttactacgtctcttctcgtggcctacgtaaggtttcggaccaaaccgtaccggtacctcccgtacgtaaccctaagtttccgtgggacccttaccgacgggtacgttacggaacggtaacgggacggacgtttaagttaaacgttttttaagcgttaccttaccctacctaattacttaaccggaacgcaacggcgaactccccgtaaccttagttacgttacgttaaccggaaacgttccggggaaactaacggtaccacccggtttaccgtacggttaccgacgtaacccgaacgtacccgaaacccctaacgtttccgtacgtaccgttccgttacccgttaccccccgttcctcccccgttagtacggtaacgtacggtccttaacgacggacgggtacggcgtacggtaacgggagggacctacgtaacgtagtcacgtagacctgacnganagnnctcgntanagngancganacgatcacacgatc

SEQ ID NO: 281430 - DNA, 760 bp, Homo sapiens
  misc_feature: GYAE6OF02FNQW6.38.38.D05.1.454.CMB.1.raw
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcacatctcctgcacgtggancagtagngactagttggtagttaactaacttgtcgtcctccgtacggtaaccaaacaaccacccgaggtaccaaaaccgccccaaaatcaactctaatttancggtacctacactcgacgtccggtccctggttacgggtttctactccgtcttccgtcgtcgtctaccgtaggttcggaaccacgtacccggcctccgtagtaccttagttcgacggtcctcggaggtcctaggaacggtacggtagtcgtttaagtttaactttttcgacgttccttacctacttaacgttaacgtaccgcggaacaccggtacacccggtacccctttaccgttacgttccgttaccgtaccgggtaaccgtacgggtaaccgaaccgttcccgtaacccggttcccgtaacgtaacccggacccgtaaccccgggtaaaccgtacccccgtaaacccgtcgttacccggttacctaccgtttacccgttaccccggttaccccctaccccgttcccgtaacccgttacgggttaccaccggtaccgttaccggtacgggtaccgggtcccggtaacgg

SEQ ID NO: 281431 - DNA, 752 bp, Homo sapiens
  misc_feature: GYAE6OF02J0J50.38.38.D05.1.454.CMB.1.raw
  modified_base (145)..(145): a, c, t, g, unknown or other
  misc_feature (145)..(145): n is a, c, g, or t
  modified_base (221)..(221): a, c, t, g, unknown or other
  misc_feature (221)..(221): n is a, c, g, or t
  modified_base (353)..(353): a, c, t, g, unknown or other
  misc_feature (353)..(353): n is a, c, g, or t
  modified_base (417)..(417): a, c, t, g, unknown or other
  misc_feature (417)..(417): n is a, c, g, or t
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
tcagtcgatcacgtcacgaccggtgctcgatttagtatctgatagttgggttgggggctttgcctgggctctgctgctcctcaccctcctcactcagggcacagggtcctggcccagtctgccctgactcagcctgcctcgttcnggtctcctgacagtcgatcaccatctcctgcacgtggaagctagtagtgactagttgggtaggttaataaacgttntcggtccttaccgttacggtaacccaaacaaccacccgtaggaccaaaaccgaccccctaaatcctattactaatttacgtcgacgtccactacgacgtccggccctcgtacgggtttcctacgtcgcttcnctggtaccttacgtacggttcgacctaaccgccgtccctccgacgtacctgtttcgtcggtccnccgtacggcgtaggacggtacgaggtcttaagttaatttntcgtacctctanattaacgtacgacggtcacgtacgtaccgtacccttaccgttagtaccgttaccgttaacgggtaacgtacgggtaactacccgggttacctaccccgggtttacccgtaaccggtaccgtaaccggtacccccggtaaaccgtacccccgtaaaaccgtcgttacccgttaccgtacccgtttccggttaccccgttacccccgtaccgttaccgtaacccgttaagggttcctacccggttcggttaacccggtgggaaccgggttaccggtgtaaccggg

SEQ ID NO: 281432 - DNA, 769 bp, Homo sapiens
  misc_feature: GYAE6OF02I942C.38.38.D05.1.454.CMB.1.raw
  modified_base (299)..(299): a, c, t, g, unknown or other
  misc_feature (299)..(299): n is a, c, g, or t
tcagtcgatcacgtcacgaccggtgctcgatttagtatctgatagttgggtttggggctttgcctgggctctgctgctcctcaccctccgtcactcagggcacagggtcctgggcccagtctgccctgactcagctgcctccgtgtcgtgggtctccgtggacagtcgatcaccatccgtccgtgctactgggaaacgctagtacgtgacctagttcgggtagttactaactgtgcctcgtacggtaccaacaaccgccaggaccaaacggtcccccaaagttcacgttcacgtttagngacgtcctactcacgtccggaccctacggttcgggtttcctacgtccgtccttacgttccgtagtccgtacgttaacggtttcgggaactaaccggtcccggtcctacccgtttacgaccgtttactttcggtcgggtaccttccgaaggttctacggaacgggccgtaacggtcttaaggttttaaactttttcgtacgccttacccgttactaagtttacgaacggttacgtcgaaccggactaacggtacccctttaccgttagttccgttaaccggtcggtaacggttacggaccggtaacgttcccgtacccgtttaccgaccgttacgaacccgtaccccgtaaccgaccccgaaaccgtgttaccccgttacgtaaccgtcccgttaaccggtttcccccgccttaccccggtcgtaacccgtttggaacctacggtccgttacgggaccggtccggttacgg

SEQ ID NO: 281433 - DNA, 762 bp, Homo sapiens
  misc_feature: GYAE6OF02IJ3VM.38.38.D05.1.454.CMB.1.raw
  modified_base (181)..(181): a, c, t, g, unknown or other
  misc_feature (181)..(181): n is a, c, g, or t
  modified_base (221)..(221): a, c, t, g, unknown or other
  misc_feature (221)..(221): n is a, c, g, or t
tcagtcgatcacgtcacgaccggtgctcgatttagtatctgatagttgggtttgggggctttgcctgggctctgctgctcctcaccctcctcactcagggcacgagggtcctgggcccagtctcgccctgactcagcctcgcctcggtgtctgggtcctccgtggactagtcgatccaccntcctcctgcacgtggaagcagtagtgactagggggggttntagttaataacttctcgttcctccgtacggtaacccaaacaaccaccaggaccaaaccgacccaaatctatactattatcgacgtcactcacgtccggaccttcgtacgggtttctaccgtcgtcttctcgtcgccttactagttcgactaacgaccgtcctccgatacctacttcgcggtcctacgacgtcgtaggacggtacgacggtacttacgttaacgtttttactcgttaccgttcctacgttaacttaacgtacgttagggaccgtaacgtaccgaaccggttaccccgttaaacccgtttagttccggttaacggtttaccgggtaacggtaccgggtaaccggtacgttacccggtaccgttacccgtaccgaccgaacccgtacccgaaccggtaacccctaaccccgtacgttcccgtaccgttacccgtttacccggtccccgttacccccgttcccttacccgttaaccgtacccggttaaccggtacctttacccggaacggttcggtaccgggtccgggtacccgg

SEQ ID NO: 281434 - DNA, 680 bp, Homo sapiens
  misc_feature: GYAE6OF02IK30D.38.38.D05.1.454.CMB.1.raw
tcagtcgatcacgtcacgaccggtgctcgatttagtatctgatagtttggggtttgggggctttgcctgggctctgctgctcctcaccctcctcactcagggcacagggtcctgggcccagtctcgccctgactcagcctgcctccgtgtctgggtctcctggacagtcgatcacctatcctcctgcacgtggaacgcagtagtcgactagtttggtgttaataacttatcgttctcctaggtaacccaacaaccacccgaggacaaacgaccccaatcactactatttatcgacctcactactaactcgtacccttggtacgggtttctacgtcgtacttctcgtcgtcctacgtaagttcggacctaacgccgtcctaccgtcacttacgttcgtcggaccgtccgaggtccgtaggacgggtacgaacggttcttacgttaatttttacgtacgtccttaactaactaataacgtacgacggtcaacgccacgttacccctacgtttacgtcgttccgtacggtacgaccggaactacggtccctaccgttccacgtcgaacccgaccgaaccgtcccaaccctaacgttcctacctaacctttcggtccccttccccggacccttaaccgcctaaccgtacgtactacccggacgtacgttacgggcggtaaccgg

SEQ ID NO: 281435 - DNA, 726 bp, Homo sapiens
  misc_feature: GYAE6OF02G4AXP.38.38.D05.1.454.CMB.1.raw
  modified_base (160)..(160): a, c, t, g, unknown or other
  misc_feature (160)..(160): n is a, c, g, or t
  modified_base (166)..(166): a, c, t, g, unknown or other
  misc_feature (166)..(166): n is a, c, g, or t
  modified_base (196)..(196): a, c, t, g, unknown or other
  misc_feature (196)..(196): n is a, c, g, or t
tcagtcgatcacgtcacgaccggtgctcgatttagtatctgatagttgggtttgggggctttgcctggctctgctgctcctcaccctcctcactcagggcacagggtcctgggcccagtctgccctgactcagcctgcctccgtgtacgtgggtctccgnggtacngtcgatcaccagtctcctgcacgtggaacnctagtagtgactagttcgggtagttaataacttgtcgtcctaccgtaggaaccaaacgaaccacccgaagtaccaaaccgaccccaacgtcactactatttagacgtacgtactctactacgtcccggtcccgttaggttacgggtttacactcgttccttcgtcgtcgtctacgtacgttcgacaacgtccgtcctacctacgtcttacgttccgtcggtcctaccgtcgcgtaggaacgcggtacgtcgttaacgtttacgttttacgtcgtaccgtactactaacgttacgtaacgtcgacgtagaccgtaccgtcccttacttggtacggttaccgtacggtacgtaacggtacgtacgtcccgtaaccgttccgtacgtacgacccggacgtaaccccgacctaaacccgtcgtaccgttaccgtaccgttacccgtacccgtttcccggtacccttacccggttaaccggtaccgtaccgtacccggttacgggacccgtcgggtacccggtacccggtacggg

SEQ ID NO: 281436 - DNA, 697 bp, Homo sapiens
  misc_feature: GYAE6OF02HDVGS.38.38.D05.1.454.CMB.1.raw
  modified_base (187)..(187): a, c, t, g, unknown or other
  misc_feature (187)..(187): n is a, c, g, or t
tcagtcgatcacgtcacgaccggtgctcgatttagtatctgatagttgggttggggctttgcctgggctctgctgctcctcaccctcctcactcagggcacagggtcctggcccagtctgccctgactcagcctgcctccgtgtctgggtctcctggacagtcgatcacctatctcctgcactggancagtgtgacagtttgggtagttaataacttattcggtccttaccgtggtaacccaaacgtaaccacccgaggactaaaccgccccaaactcattccgaatttacgtgaacgtctacgtctacgtccggcccctagtacgggtttactaccgtcgtcttactcgtcggcctacgtaagttcgacgtaaccgcggtccctcctcgtacctacgttcgtcggtcctacgacggtctagggacgacggtacgtactaggttaacttttgttctccgtactactaattacgtacgaggtcgacgacgtactacctaccgttagtcgttaccgttacggacgtcggaaccgtacgtccgtacccgttacgtccgttaccgaccgtacccgtaaccggtaaccctaacccgtacgtaccgttcctaccgttacccggtcccgttaccccctaccgttcccgtaccgttaccggtacgtacggttacccgacggttcgggtaccggtacgggtaccgg

SEQ ID NO: 281437 - DNA, 762 bp, Homo sapiens
  misc_feature: GYAE6OF02GW6WD.38.38.D05.1.454.CMB.1.raw
  modified_base (227)..(227): a, c, t, g, unknown or other
  misc_feature (227)..(227): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatccaccatctcctgcacgtggaacgcagtagtgactagtttgggtgtttaataaacttnttcgtctccgtacggtaacccaacgaacacccaggaccaaaccgccccaaaactccactactaatttactgaccgtactcctccgacttcccggcccttaggtacggggttttacctacgttccttccgttcttaccgtcggtaccttactaacgggtttcggaacctaacccgtaccggcccttcccgtacgtaaccttacggtttcgtaccgggtccgtaccgaggttcctacgggagtaccgggtacgtacgttacgtttaacttttacgtttcgcccgttacccgtagtaccgtttacgtaacggcggaccacggtacctaccgacccttacccggttattaccggttcggtaaccgtacggtaccggacgttacggtacccgtaccgtaccgtaccgtacgaaccgtaccgaacccggaccccgtaaccgtaccctacggttacccctacttcccgttcccggaccccttccccgtcctaccgttacgtacgaccggtttaccgaccggtttacggcggtaccggtccgg

SEQ ID NO: 281438 - DNA, 656 bp, Homo sapiens
  misc_feature: GYAE6OF02GQ2R1.38.38.D05.1.454.CMB.1.raw
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (595)..(595): a, c, t, g, unknown or other
  misc_feature (595)..(595): n is a, c, g, or t
  modified_base (606)..(606): a, c, t, g, unknown or other
  misc_feature (606)..(606): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtcgtgggtctcctggacagtcgatcaccatctcctgcactggaagcagtagtgactagttggtggttataactattcgtcttcctaggtaaccaaaccaaccacccgaggaccaaaccgccccaaactccaatctatttatgacgtcactcatccggcctcgtagggtttctactcgtcttctctggctcaggttggacacgacgccctccncgacctnttcgtgggcctcgacggctggacggacgaggtcgttagttaagttttacgttgtccttacctctaactagttaccgaggacgagccgtacgacccttaccctttatcgttacgttaccggaacggtcgggaacctacggtacctacccgttacccgtaccgtccgaccgaccccgaacggacccctaaaccccgtccgtcgtacctacctaccgttcccggttccccccncccgttacccnccgtacgttaccgtacgtacccggaccgtggtaccgggtccgggtaccgg

SEQ ID NO: 281439 - DNA, 672 bp, Homo sapiens
  misc_feature: GYAE6OF02I4G28.38.38.D05.1.454.CMB.1.raw
  modified_base (526)..(526): a, c, t, g, unknown or other
  misc_feature (526)..(526): n is a, c, g, or t
  modified_base (621)..(621): a, c, t, g, unknown or other
  misc_feature (621)..(621): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggagcagtagtgactagttggtagttaataactatcgtctcgtacggtaccaacaaccaccgagacaaccgaccccaactcactactatttatgtacgtctactacacgtccggccctcgtacggggttttcctacgtcgtcttctcgtcggtacctaccgtagtttcggaccaaccgtaccggtccctcccgtcgtacccttacgttttccgggtacggtccctaccggacggttacgtacgggacgggtaacggtcggtacgtttaggttaatttttacttcgtccttccgtactacttaactacgacggtcacgtaccaaccgtcctaccctttagtnttccgttacggtacgtaccggacgtacgtcctaccgtcgtaccgtacaccgtaccgacgacccaacctcgtcgtctaccgtccgtccggtccccncccttccgtaccgtcgtacgtaccgtccgtacgcggtacggtcggtaccgg

SEQ ID NO: 281440 - DNA, 783 bp, Homo sapiens
  misc_feature: GYAE6OF02FR32J.38.38.D05.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctccgtggacagtcgatccacatctcctgcacgtggaacncagtagtcaacgtgtttgggtaggttaactaactntcgtcctccgtaggtaccaacaccgacccgaggaccaaaccgcccctaaactcgacttactatttacgagtaccgtcaactcacgtccggtcccgtggttcggggttacctaccgtcgtaccttctcggtcgtccttaccgtaaggtttcggaccacgtacccgggtccctaccgtccggtactacgttacgtcggggtaccttacggtacggtctagggaaccgggtacggtacggtaccggttagtttaacttttacgaccggttcccttaaccgtacttaacgtacgttaccggacggccgtaaccggacaaccgttacccgttaccctttaacggtccgtttaccgggttaccggtaaggttcccgggtaaacctaaccgggttacccggtaccttcccggtaacggttccgtaaccggtacccgaaccggtaccccgtaaacccgtaccgtacgttaccctacccttacggtccccgttcccctaccccggtaccttaccggtaacgttcggtaccgttccgtaacggttcggacggtcccgttaacggg

SEQ ID NO: 281441 - DNA, 761 bp, Homo sapiens
  misc_feature: GYAE6OF02HOSW9.38.38.D05.1.454.CMB.1.raw
  modified_base (166)..(166): a, c, t, g, unknown or other
  misc_feature (166)..(166): n is a, c, g, or t
  modified_base (197)..(197): a, c, t, g, unknown or other
  misc_feature (197)..(197): n is a, c, g, or t
tcagtcgatcacgtcacgaccggtgctcgatttagtatctgatagttgggtttgggggctttgcctgggctctgctgctcctcaccctcctcactcagggcacagggtcctgggcccagtctgccctgaactcagcctgcctccgtgtctgggtcctcctgggacnggtcgatcaccatctcctgctacgtaggaanctaaggtagtacgactagtttgggtacgtttaataacttattcggtcctccgttacgggtaaccaaacaaccgacccgaggaccaaaccgtaccccaaatcatactattagcgacgtctacacacgtccggtccctggtagggtttcctacgttccgtcttctcgtcggtcctacgtaacggttcgacaaccggccggtccctaccgtacgaccttacgttcgcggggtaacctccgtaacggtacgtacgggtaagggacggtaaggttccgtaaagggttttaacttttacgtaccggtccttacccaagttaacttaacgcgtaacgggtacgtacggacgttaacccggtacccttaacccgttagtaccggttaccgtttaaacgggacgtaacgggtaaccggtaacggttcccgtaccgttacctacggtacccgaccgggtaacccgaacgtaccccaaaccgttacgtccgtacctacctcccggtttaccctaccccgtaccctccgttaacggccttacgtacgtaaccgtcggacggtacggtccggtacgg

SEQ ID NO: 281442 - DNA, 761 bp, Homo sapiens
  misc_feature: GYAE6OF02I769P.38.38.D05.1.454.CMB.1.raw
  modified_base (508)..(508): a, c, t, g, unknown or other
  misc_feature (508)..(508): n is a, c, g, or t
  modified_base (532)..(532): a, c, t, g, unknown or other
  misc_feature (532)..(532): n is a, c, g, or t
  modified_base (624)..(624): a, c, t, g, unknown or other
  misc_feature (624)..(624): n is a, c, g, or t
tcagtcgatcacgtcacgaccggtgctcgatttagtatctgatagttggggtttgggggctttgcctgggctctgctgctcctcaccctcctcactcagggcacgagggtcctgggcccagttcctcgccctagactcacgccgtgcccgtccgtgtcgtgggtacctccgtgggactaggtcctaatccaacctacttccgtacctgaccgaacgtagggaacgctaagttagcgtaacctagttgggtacttaactatacgtgtacctaccgtacgtaaccaacgaaccgaccgtaacggaaccaaacccaccccgtaaattcctaacgttacttaaactttcggtaaccgtaccttaccaccgttacgtaccgtaccccggtcttacgggtttaacgggtttcctacgtccgttcttaccgtcgtacgtacctacgttaaggttccggactacgccgtacccttacacgtacttgtcgcggtactcgagtacgagagacgtcgtntaagttagttactcgacctataanagttaacacgacggtactacgactaaccgtcctacgttagtctaccgttaccggacgtaaccgggtcctaaccggccctaacgggttacccncgtaacgccgaaacccggtaccgaacccttaacgtcgttaccttacccgaccgtttacccgttcccccgtaacctaccccgttaaggccctaagtaacccggttcgaaccgtaccgggtaccgtagggcccggtacg

SEQ ID NO: 281443 - DNA, 891 bp, Homo sapiens
  misc_feature: GYAE6OF02H55GN.38.38.D05.1.454.CMB.1.raw
  modified_base (188)..(188): a, c, t, g, unknown or other
  misc_feature (188)..(188): n is a, c, g, or t
tcagtcgatcacgtcacgaccggtgctcgatttagtatctgatagttgggtttgggggctttgcctgggctctgctgctcctcaccctctcactcgagggcacgacgggtccgtgggccctaggtcttcgccctagacctccagtccctcggtccttcggtacgttcgttgggtacctccgtggaacngtcgtaactccaaccagtcttccgagacctagtaggaacgccgtaaggtaacgtgtaacgagttttacgggtaggtttaaactattagttcgttcttaccggtacggtaaacccaaaacgaaccgtaaccggaggaaacccttaaaccggaacccctaaactacgttacctattaagtttacgacgtacggtaccgtaacttctacggccggttacccttaggtacgggtttacctacgttcgtcgttcgtacgtccggtactaaccggttagttacgactaaaccgtccgccttacgcgtacttacgtttcgacggtcacccgttaggaccgtaggacgggacacgggttaacttaggtttaactttacggtacgttaccgtactaagtaacgtaacgtaacggtaaaccgggtataaccggaaccgtaccggtaaaccgttaacccgttacggttacggtttacccggttaaacggaacggtttaaaccggtaaccggttaaaccgggttaaccgtaccggttaaccccgtttaacggtaaccggaaccgttaacccaaccgggtaaaccctaaacccgtacgttaccgtaccttaccgttacccggttaaccttacccccttaccgtaaccgtacggtttaaccccgttggtaaaccgttaacccggtcggtaacgggttaccgggaccggttaaaccgg

SEQ ID NO: 281444 - DNA, 499 bp, Homo sapiens
  misc_feature: GYAE6OF01DL0GK.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggagtccctgagactctcctgtgcagcctctggattcaccttcagtagctatagcatgaactgggtccgccaggctccaggggaaggggctggagtgggtctcatccattagtagtagtggtacttacatatactacgcagactcagtgaggggccattcaccatctccagagacaacgccaagaactcactgtatctagcaaatgaacagcctgagagccgaggacacggctgtgtattactgtgcgagacgcccctcacctc

SEQ ID NO: 281445 - DNA, 505 bp, Homo sapiens
  misc_feature: GYAE6OF01ED0AU.37.51.E07.1.454.CMB.1.raw
  modified_base (499)..(499): a, c, t, g, unknown or other
  misc_feature (499)..(499): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggagtccctgagactctcctgtgcagcctctggattcaccttcagtagctatagcatgaactggggtccgccaggctccgagggaaggggctggagtgggtctcatccattagtagtagtggtacttacatatactacgcagactcagtgaggggccattcaccatctccagagacaacgccaagaacctcactgtatctgacaaatgaacagcctgagagccgaggaccacggctgtgtattactgtcgcgagacgccctccncctacg

SEQ ID NO: 281446 - DNA, 506 bp, Homo sapiens
  misc_feature: GYAE6OF01C78QA.37.51.E07.1.454.CMB.1.raw
  modified_base (307)..(307): a, c, t, g, unknown or other
  misc_feature (307)..(307): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggagtccctgagactctcctgtgcagcctctggattcaccttcagtagctatagcatgaactgggtccnccaggctccgaggggaagggctgggagtgggtctcatccattagtagtagtggtacttacatatactacgcagactcagtgaggggccgattcacatctccagagacaacgccaagaactcactgtatctgacaaatgaacagcctgagcgaccgaggacacggctgtgtacttacgtgtgcgagacnccctccnctcg

SEQ ID NO: 281447 - DNA, 610 bp, Homo sapiens
  misc_feature: GYAE6OF01B14JE.37.51.E07.1.454.CMB.1.raw
  modified_base (320)..(320): a, c, t, g, unknown or other
  misc_feature (320)..(320): n is a, c, g, or t
tcagtagtgtagatcacgaccggtgctcgatttagcatactctacaacacacaaaggggctgagagaggagccttagccctggattccaaggccctatcccacttggtgatcagcactgagcaccgaggattcaccatggaactgggctccgcttgggttttccttgttgctattttagaaggtgtccagtgtgaggtgcagctggtggagtcgtgggggagcctggtcaaggccgtgggggacgtccctgagacctcgtcctgtgcacgcctctggattccacctttcagtagctatagcagtcgaacgtcgggtcccnccgaggcctaccgaaggggaacgggctggagtggtctcatccagttagtagtagtgtaacttacattactactacgcagtactcgagtggacgggcctattccacctactcctaccgaagacgaaccgaacgaccaaacgaactcaacttagtacttctagaacctaaagtacgaaacctagcccgtaggaacgacggacccggaacggaaccgaccggtcgttaggttacgttaacgtttacgtaggttcggaccggtacggacccggtcccccttaccgacccgtacg

SEQ ID NO: 281448 - DNA, 535 bp, Homo sapiens
  misc_feature: GYAE6OF01A8SID.37.51.E07.1.454.CMB.1.raw
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
tcagtagtgtagatcacgaccggtgctcgatttagcatactctacaacacacaaagggctgagagaggagccttagccctggattccaaggcctatccacttggtgatcagcactgagcaccgaggattcaccatggaaatgggctccgctgggtttccttgttgctattttagaaggtgtccagtgtgaggtgcagctggtggagtcgtgggggagcctgggtcaagcctggggatccctgagctctcctgtgcagcctctggattccacttcagtagctatgcatgaactgggtccncaggcctaccgagggaagggctggagtggtcncgatcatagngtagngtactacgatatactacgcagactcgagtgacgggcctattcactatcctcagacgataaccgcaaagtacncacttgtatctagaccaaagtagaacngtacccgagaacgcgacccgaggaccaccggctaggttacgtaagttaccgtggtacgacgtaacggacccgccccttccgacctaccgg

SEQ ID NO: 281449 - DNA, 589 bp, Homo sapiens
  misc_feature: GYAE6OF01ADYH7.37.51.E07.1.454.CMB.1.raw
  modified_base (371)..(371): a, c, t, g, unknown or other
  misc_feature (371)..(371): n is a, c, g, or t
  modified_base (468)..(468): a, c, t, g, unknown or other
  misc_feature (468)..(468): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggcctgggggagtccctgagactctcctgtgcagcctctggattccaccttcagtagctatagcatgaactcgggtccgccgaggcctccgaggggaaggggctggaggtgggtctcatccattagtagtagtgtacttanatatactacgcagactcgaggtggacggggtccattccacctatcctaccaagacgaacaacgaccaagacctcactgtatcgagacaaatcgaacncgacctaggacgacggccggaacgggaccgacgggtccttagggttacgttaacgtttaccgtagggttacggacccggaacggtacccccggtcccccttaccccgtacccgtaacccgg

SEQ ID NO: 281450 - DNA, 854 bp, Homo sapiens
  misc_feature: GYAE6OF01EGT27.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctggggagtcccctgacgactcctcctgtcgcacgtccttcgtaggtactttccctaacctttcaaggttacgtaccttaaagttacggacctaaggtacggtaaaccgggttccgggggtaccccgacccggaacgggtcccgttacccgggaaagggggggtaaacggggtcgtaggggtaacgggttcggggttaccctacgtaaccttaccgttaaagtttaagggttaacggttagggtttaacgggtttaaaccctttaagtaaactttaaacgtttaaacccgtaaccggtaacctaaacggtaacccttaggtaacgggttacgggggaacccggggggtacccgttaacttttacccgaaacccctaacgtttccccgtaaaccgaaacgggtaaaccgaaacccggtaaacccgaacccgaaaaacggttaaccctaccgtaacgtttacgttaacttacgttacgaaaccgtaaaagtacggaaaaccgtaccggtaccgtaggaacggaaccgggaccggaaacgggtaccgaccgggtccgttaggttagttaaaccttacggtggttacggacggtaaacgaccccggtcccctcccgtacccgtaacgg

SEQ ID NO: 281451 - DNA, 516 bp, Homo sapiens
  misc_feature: GYAE6OF01EPUYP.37.51.E07.1.454.CMB.1.raw
  modified_base (449)..(449): a, c, t, g, unknown or other
  misc_feature (449)..(449): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggagtccctgagactctcctgtgcagcctctggattcaccttcagtagctatagcatgaacgtgggtcccgccaggctccgagggaaggggctggagtgggtctcgatccattagtagtagtggtacttacatatactagcagactcagtgagggcgattcaccatctcagagacaacgccaagaactcactgtactctagactaaatgaacncgactaggacgagaccgaggaccacgggctgtagtattacgtgtacgcgagacgccctccgacctcg

SEQ ID NO: 281452 - DNA, 561 bp, Homo sapiens
  misc_feature: GYAE6OF01E3OW0.37.51.E07.1.454.CMB.1.raw
  modified_base (478)..(478): a, c, t, g, unknown or other
  misc_feature (478)..(478): n is a, c, g, or t
  modified_base (547)..(547): a, c, t, g, unknown or other
  misc_feature (547)..(547): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaggtgtccagtgtgaggtgcagctgggtggagtcgtgggggagcctggtcaagccgtggggactccctgagactctccgtgtgcagcctctggattccacctttcagtagctatagcatgaacgtggtcccgcaggcctaccgaggggagggctggagtggtctcatccattagtagtagtgtacttacgattatactacgcaagtctcgagtggacgggcctattcgacctatcctccaagacgaccaaccgaccaaacgtaacctcaacgttagtactctacgaactaaatacgaaacncgtaccgtagacggacgcccggaacggaccacgggtcttaggttacgttattacgtgtagccgagaccncccctccgcctacg

SEQ ID NO: 281453 - DNA, 583 bp, Homo sapiens
  misc_feature: GYAE6OF01C6T97.37.51.E07.1.454.CMB.1.raw
  modified_base (440)..(440): a, c, t, g, unknown or other
  misc_feature (440)..(440): n is a, c, g, or t
  modified_base (495)..(495): a, c, t, g, unknown or other
  misc_feature (495)..(495): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggagtccctgagactctcctgtgcagcctctggattcaactttggtagctattggatggactgggtccgcagtctccgagggagggctggaggtgggtggccaacgatacgaggggaggtggtaggtaacgaaaaactgtgtggactcgtggtggcggggccgattcaccatctcagagacaacgacaaaactcactcgtatcngacaagtcgggaccgctggaacgtacgtccggaaggaccgacggtcgttcggttnttaagtttagttggttaggaccgtaaggtagtagttttaacgaacttaaacgtaaaggttttacggagttacggtacgttggttaacg

SEQ ID NO: 281454 - DNA, 568 bp, Homo sapiens
  misc_feature: GYAE6OF01DCJZK.37.51.E07.1.454.CMB.1.raw
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactgggctccgctgggtttcctgttgctatttagaggtgtccagtgtgaggtgcagctgggtggagtcgtgggggagcctggtcaagccgtggggacgtccctgacgactctccgtgtgcagcctgtggattccacctttcagtagctatagcatgaactcgggtccncgaggcctaccgaggggaagggctagggaggtgggtctcatccaagttagtagtagtcggtaacttanatatactacgcagactgaggtggacgggccattccacatcncagacgacaacgaccaagaactcactntactctagactaaatcgaaacgcgtccgtaggaagaccggaccggaacgggaaccgaccgggtctagggttacgtactttacggtggtaccggacggaacgacccggcccctaccacccgtaccg

SEQ ID NO: 281455 - DNA, 547 bp, Homo sapiens
  misc_feature: GYAE6OF01B5UTF.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctggggatccctgagactctcctgtgcagcctctggattccaccttcagtgctatagcatgaacgtgggtcccgccaggctccgaggggaaggggctgggagtcgggtctcgatccagttagtagtagtggtacttacatactactacgcagactcaggttggacggggtccgattccaccatcctccaaggacacaacgaccaagaacctcactgtatctagactaaatcgaaacagcctaggacggacggccggaaggaccgacggtcttggtagttacttacgtgtcgaccgagaccgcccctacccgcctacg

SEQ ID NO: 281456 - DNA, 641 bp, Homo sapiens
  misc_feature: GYAE6OF01EB6AE.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttcctgttgctattttagatggtgtccagtgtggaggtgcagctggtgggagtcgtggggggaggcctggtacaagccgtggggactccctgagactctcctgtgcagcctctggattccaccttcagtagcttatagcagtgaacgtggggtcccgcgaggcctaccggaggggaacggggctgggaggtcgggtctcgacgttcctaagttaggtagttaggttacggttacttaacgattagtactaacgctaacggactcgaggtcggaagggggccgtaagttacccaacctattcccaccgaacgtaagaaccaaccggacccaaagaacctacacttaggtattacgtacgtaactaaattacgaaaccacgcccgtaggaacgacggacccggaacggaccggaacggtactaggttagtaaccgttttacgtcggttacggacggtaaggacccgtcccctcccgtaaccccg

SEQ ID NO: 281457 - DNA, 688 bp, Homo sapiens
  misc_feature: GYAE6OF01BSTRW.37.51.E07.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (539)..(539): a, c, t, g, unknown or other
  misc_feature (539)..(539): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctggtttcctgttgctatttagaaggtgtccagtgtgaggtgcagctggtggagtcgtgggggagcctggtcaaggccgtgggggactccctgacgactctccgtgtgcagcctctggtacttcacctttnagtagctatagcagtggaactgggtccncaggcctcgaggggaagggctgggagtgggtctcgatccaatttacggagtaggtggtaacttacatatactagcagactgtagtggacgggtaccgtacttcaaccctacgttacctaccgtaacgggaacgaacccgtaaacccggaccctaaaacgggtaacccttaccgaaaccgtttcggttaacttcccggtttagaaccgtaaaacgttacgggaaaacccncggtaaccccgttaggaaacgggtaccggaacccggggtaaaccgggaaccggtaaccggggtcgttagggttaaggttacgtttaaccgttgggttacggaccgggtaacggtaccccgtaccccccgttaccgaccccgttaacccg

SEQ ID NO: 281458 - DNA, 514 bp, Homo sapiens
  misc_feature: GYAE6OF01BFCZU.37.51.E07.1.454.CMB.1.raw
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttactattttagaaggtgtccagtgtgaggtgcagctggtggagtcgtgggggagcctggtcaagcctggggatccctgagactctcctgtgcagcctctggattccaccttcagtagctatagcatgactgggtccgccaggctccgaggggacgggctgggagtgggtctcatccattagtagtagtgtacttacntatactacgcagactcgaggtggacggggccgattaccactatcctacagacgaacgaccgaccaaagactcattntactngacaatgaacngctagacgagccgaggcacgcgtgtgtattcngtgacgacgacncccctacncctgacg

SEQ ID NO: 281459 - DNA, 804 bp, Homo sapiens
  misc_feature: GYAE6OF01CDWMY.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggccgtggtcaagccgtggggacgtccctgagactctccgtgtcgcacgcctcgtggactttccacctttcgagttacgacttagtacgctattcggaacgtcggggtacccgccgacgggccgtaccgggaaggggaacggggcgttagggaggttcggggttccctacgtacgttaccgtaagttttaacgggttaaggtttaacgggtttacggtttaaacctttaaccgtaatttaacgtaacccgttacggacctaaggtacccttacgaagggttcgggaacgggggtacccgttaacgtttacccaacccgtaacttcccgtaaccgaacggtaaccgaaccgtaaacccggaaccccgtaaacgtaacccttacgaaccgttacggttaacttccgtacgaaaccgtaaaacgttacgaaaccgtacggtaccgtagggaaccgtaaccgggaccccgggaaacgggaaccgtacccggggtcctttagggttacgttttaacgtttacggttaacgggtcggtacccggtaaccggtaccccggtccccccttacccgtaacccccgttacccgg

SEQ ID NO: 281460 - DNA, 794 bp, Homo sapiens
  misc_feature: GYAE6OF01C1HDK.37.51.E07.1.454.CMB.1.raw
  modified_base (278)..(278): a, c, t, g, unknown or other
  misc_feature (278)..(278): n is a, c, g, or t
tcagtagtgtagatcacgaccggtgctcgatttagcatactctacaacacacaaagggtctgagagaggagccttagccctggattccaaggcctatccacttggtgatcagcactgagcaccgaggattcaccatggaactggggctccgcttgggttttccttgttgcttattttagaaggtgtccagtgtgacgtgcaacgtggtggagtcgtgggggaggtcttggtccaggccggtcggggggtcccctgacgacttctccgtgtgcagcctntggattcaacgttttggagtctatagcatgaacgtcgggtccgccgaggcctccggaggggaagggcgtgggaggtcgggtctacacgttcctagtttaggttaaggttaggttacggttaactttaacgatttaacgtaaccgtaccgacgtaacgaccgtttaccgaagggttacgggacggggggtcccgttaacgttcccgtaacccgtacttacccgtacccgaaaggaaccgaaacccgaaacccggacccgaaaacggtaaacccttacccgtaacttacggtttaactccgttaacgaaacctaaaagttaaccggaaaccgtaccgggtacccttaagggaaccgtaaccgggaccccgggaaacgggtaacccggaccggggtacccgtttgggttaaccggttttaacgtttacggttacgggttcgggaacccgggttaaccggaccccggttacccccccttaccccgtaaccccttaccggaaccggtccgaaacccggggg

SEQ ID NO: 281461 - DNA, 819 bp, Homo sapiens
  misc_feature: GYAE6OF01B7STG.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactgggctccgctgggttttcctgttgctatttagaggtgtccagtgtgaggtgcagcgtgggtggagtcgtgggggagcctggtcaggccgtggggactcctgagactctcctgtgcagcctcgtggattccacctttcgaagttacggtcttaagtacgtacctagtacggtaaccgttcggggtaccccgccgaacggggtcccttacccgggaaggggggaaacggggtccgttagggggaacggtttcggggtacctacgtactaccgtaagttttaacgggtaagtttaggttacggttaacctttaaccgaatttaacgtaaccgttacgaccgtaaggtaacccttacggtaggttacgggaacggggggtacccgtacgttaccaacccgtacgttacccgtaccggaacgtaaccggaacccgtaaacccggacccgtaaaacgtacctaccgtaacgttacgttacttaccgtaacggtaacgtaaacgttacggaaaccaccgggtacccgttaacggaacgggttaacccgggaaccccgggtaaacgggtaaacccggtacccgggtacggttttacgggtaacggttttaacgtttaccggtacgggttaccgggaacggttacggtaccccgtacccccgttaaccccgtcccgttaaacccgg

SEQ ID NO: 281462 - DNA, 597 bp, Homo sapiens
  misc_feature: GYAE6OF01A78UJ.37.51.E07.1.454.CMB.1.raw
  modified_base (315)..(315): a, c, t, g, unknown or other
  misc_feature (315)..(315): n is a, c, g, or t
  modified_base (384)..(384): a, c, t, g, unknown or other
  misc_feature (384)..(384): n is a, c, g, or t
tcagtagtgtagatcacgaccggtgctcgatttagcatactctacaacacacaaaggggctgagagaggagccttagccctggattccaaggcctatccacttggtgaccagcactgagcaccgaggattcaccatggaactggggctccgctgggttttccttgttgcttattttagaaggtgtccagtgtgaggtgcagctgggtggagtcgtgggggaggcctggtcaagccgtggggatccctgagactctcctgtgcagcctcgtggattcaccttcagtagctatagcatagaacgtcgggtccgccgnggcctccgaggggaagggctgggagtgggtctcatccagttagtagtagtgtacttacatactactacncagactgagtggacgggtcgattcacctatctcgagacgaacaaccgaccgaaactaacctactacttcgtactacgtcgaacaaagtacgaaacgacgccgtagaacgacggaccggtaacggaccgtaccggtacgttcggttagttacgtttaccgtaggttacgaccgggtacgtaacccgtaccccctaccccgtacccttcgaaccg

SEQ ID NO: 281463 - DNA, 762 bp, Homo sapiens
  misc_feature: GYAE6OF01DH1T3.37.51.E07.1.454.CMB.1.raw
tcagtagtgtagatcacgaccggtgctcgatttagcatactctacaacacacaaagggctgagagaggagccttagccctggattccaaggcctatccacttggtgatcagcactgagcacgaggattcaccatggacgtgggctccgcttggttttccttgttgcttattttagaaggtgtccagtgtgaggtgcagctgggtggagtcggtgggggagcctggtcaaggccgtggggactccctgagactctccgtgtcgcacgtcctctggtactttccacctttcgagtacgctatagctagtacggaaccgttcgggtcccgccgagggtcccgtaccgggaagggggaacggggtcgttaggggtacggttcgggtcctaccgtacgttaccgtaagtttaacgggttaaggtttaggtttacggtttaaacctttaactaagtttaacgttaacccgtaacggtccgtaaacgtaccgttacgtaaggggttaccgggaaccgggggtaccccgtaacgtttacccgaaccccttacgttaacccgtaacccgaacggaaccgaaacccaaacccggaaccccgaaaacgtaacccgttactaacccgtttagttactacccgttagaaaccctaaaagtcgaaacctacgaccgtaggaacggaccggtaccgggacggacgacggtacgtggtttacgttaacgtttacggtggtacggcgaacggtcccgaccccctccgtacccgtaccgg

SEQ ID NO: 281464 - DNA, 560 bp, Homo sapiens
  misc_feature: GYAE6OF01DZFB6.37.51.E07.1.454.CMB.1.raw
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggagtccctgagactctcctgtgcagcctctggattcaccttcagtagctatagcatgaactgggtcgcaggctccgagggacgggctggaggtggtctcgatccagttagtagtagtggtaacttacgatactaactacgcagactcgtagtcggagggtccagtttccaccgtatctaccagacaacaacgccaaagacctcactntatcctagacaaagtgaacngacctggaacgtacgaccggaaggaccacggtccgttagtacgttagtttaccgtgggtacgccggtaacgacccgtccccctccgaccctaccgg

SEQ ID NO: 281465 - DNA, 794 bp, Homo sapiens
  misc_feature: GYAE6OF01CMT8J.37.51.E07.1.454.CMB.1.raw
  modified_base (750)..(750): a, c, t, g, unknown or other
  misc_feature (750)..(750): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaacgtggggcctccggtcgttcgggtttttccttggttgtcttagttttaggaaggtgtccaggtgtggaggtgcagtcgtgggtggaggtcggtgggggacggtccgtggtaccgaaggtccgtggggactcccgtggacgtacctctccgtgtcgcacgtccttcgtaggtactttcctaccgttcgaaggtctcttaagtacgcctagtacggtaaccgtccggggtaccccgaccggacgggtacccgtaccgggaagggggacggggtcggtaggggtacggttccgggtaccttacgacgttaccgttaaggtttagggtaaggtttaggtacggttaacttaagtaacttaaccgtaccgtacgacgtaacgtaccttcggtaacgggtacgggaccgggtacccttaatacccgactacgtacccgtaacgaacggaaccgtaacccgaaaccgtaccgtaaacggttaccctactaacggtttagtaacctttaccgaaggtaaccgttaaaacgacggtaaacccgacgtacccggtagggaaccgggtaccggaacccggaagggtcccgtaacggtcgttaaggttaactcggtttacgngggtaccgacccgttaacgacccgccccctaaaccgtccgtacg

SEQ ID NO: 281466 - DNA, 761 bp, Homo sapiens
  misc_feature: GYAE6OF01ALA1W.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttggttttccttgttgcttattttagaaggtgtccagtgtgaggtgcaactggtggagtcgtgggggaggcttgggtccaggccgttcgggggggtcccctggacgtactccttccgtgtgccacgtcctcgtggtacttactaacgtttggtagtcttagttggagtcggacgttcggggtccgccgagtccgtccggaggggaaggggtcgtgggaggtgggtacggaccaagtagtacggagggggtagggttgggtaacggtaaacggtaaaaacgttggtaggtggtaccgttcgtcgggttcgggtccggggccgtacgttaccaaccgtctccgtaccgacggaacgaaccctaaaccgaaaccctaaaaactacctaacttagttaactaccgtacggaactaaacggttcgggaaccggtcccgtaggaacggtacgtaccgggaacgggacccggtacggtcgttaggttacgttaatttaggttacgttcgggtaacggtaagggttaaagttaagttttaaacggtaactttaaacggttaaacggttttaccggtaaaggttcggtaaacggtttaggtttaagttaggttaacgg

SEQ ID NO: 281467 - DNA, 843 bp, Homo sapiens
  misc_feature: GYAE6OF01CEWMQ.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgcttattttagaggtgtcagtgtgaggtgcagctggtggagtcgtgggggagccgtggtcaagtccgtggggactcctgagacctctccgtgtcgcagtcccgttcgtggtactttccgacctttcgaacgtcgtcctaatacggctagtacggaaccgttcggggtcccgaccgaggtccgttaccgggaagggggtaacggggtcgttaggggagggtttcggggttacccttacggtaacgttacccgtaagtttttaacgggtaacggtttacgggtttacgggtttaaacctttaacgtaacgtttaaacgttaacccgtaaccggtacgtaaacggtaccttacggaacgggttacgggaccggggggtacccttaacgttacccgaacccctaacgttcccgtaacccgaaagggtaaccgaaacccgaaacccggaacccgtaaaacggtaaccccttaacggtaacccgtttaacgtttacgtaccgtaacggtaaaccgtaaaacgttacggaaaaccgtaccggttacccgtaagggaaccgggtaccggaaccgggtaaccgggaacctaccggggttactttacggttaggtttaaaccgttacggttacgggttacggaccgggtaacgtaccccgtaccccttcccgtaacccgtaccgg

SEQ ID NO: 281468 - DNA, 799 bp, Homo sapiens
  misc_feature: GYAE6OF01CFNVA.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggacttcaccatggaacgtgggctccgctgtacgttttccttgttgcttattttagaggtcgtcagtgtgaggtcgcagtcgtggtgggagtcggtggggggacgtccgttggtacaacggccggtaggggtacctccctggacgtactccgtccttgtcgcgacgtccgtcgtacggtacttaccgtacccttcgaaggttacgccgttaatacgtacctaagtacggtaaaccggttccggggtccccgtaccgacgggtacccgtacccgggaaggggggtaacgggtcggtagggtacggttcgggtcctactacgttacgtagttaaggtaggttacggttacggttaccttaagtattaacgtaccgtaacgaccgtacggtaacctcggtagggtacggggtaccggggtaccctaacgttccccaaccgttacgtaccctaccggaaacgtaaccaacccggtaaacccgaaccgtaaaccgtaacccttactagttacgttaactaggtaaccgaacctaaagtacgaaacctcggtaccgtaaggaccgtacccgggaccgaaacgggtacccgttacgggtcgtttaaggtttacgtttacgtttaccgggacggttccggaacccggtaaccggaccccttcccccgtaccccgttaaccgg

SEQ ID NO: 281469 - DNA, 652 bp, Homo sapiens
  misc_feature: GYAE6OF01B4BDA.37.51.E07.1.454.CMB.1.raw
  modified_base (342)..(342): a, c, t, g, unknown or other
  misc_feature (342)..(342): n is a, c, g, or t
  modified_base (486)..(486): a, c, t, g, unknown or other
  misc_feature (486)..(486): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaacgtggggctccgcttgggttttccttgttgcttattttagaggtgtccagtgtgaggtgcagcgtgggtggagtcggtgggggagccgtggtcaaggccgtggggactcccgtgacgacttctccgtgtcgcacggtccttcgtggtacttccacctttacgagtacgtctaatacgctagtacggaaccgtcgggtacccncgaggtccgtaccggaggggacgggtctggggacgtcgggtctacgtactccgtaagttaggtagtaggttacggttactaactataacttacgtacgcgaaggtacctcggtaggtagggacgggtacctattacccaacgtntccgtaccgagacgaaccaaccgactaacgtacctcgtactacgtacaccgtagaacctaaagtccgaactcgtaccgaggaccgtaccgcggtaaacggccgtacggtcttacggttagttactaccggtggaccgtacgacgaccccgtcccctacgccgtacg

SEQ ID NO: 281470 - DNA, 656 bp, Homo sapiens
  misc_feature: GYAE6OF01B51JI.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcgaagccgtgggagtccctgagactctccgtgtgcagcctcgtggtactttccacctttcacggtagtctaatagacgtagttaggtaaccgtcgggtccccggccgacggccgtaccggaaggggacggggcgtgggtaggtcgggtctacgacttcctagtttacggtagttagtaggttaacttacgtaattactacgtacgacgacgtactacgaggtacggacggggaccgttactccgaaccgtacttacccacgtaacgacggtaaccgaaccgacccaaagaacctacgaccgttagtacgtaccgtacgtacctaaagtcgaaacacggtccaggacgacggaccggagaccgtacggtcgttacgtaggtttacttacgtgtacggtacgacggtaccctcccgtacccgtccgtaccg

SEQ ID NO: 281471 - DNA, 753 bp, Homo sapiens
  misc_feature: GYAE6OF01C5GIJ.37.51.E07.1.454.CMB.1.raw
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
tcagtagtgtagatcacgaccggtgctcgatttagcatactctacaacacacaaagggctgagagaggagccttagccctggattccaaggcctatccacttggtgatcagcactgagcaccgaggtattcaccagtggaacgtggggctccgcgttgggttttccttgttgtcttagttttagaggtgtccngtgtgaggtgcagngtggtcggagtcggtggggagccgtggtacgaagccggtaggggacgtcccgtgaacgtccttctccgttggcgccgagtccctgtaagtcttcctaccgttcagtagcctatagcagtacggaacgttccgggccgtccgacggtccgtacggaaggggagggtccgtagggtaacgggtcggtactacgtaacgtaccttaaggttaaggttaccggtgtttaacggttactttaaacgaactttactaaccgtaccgaacgtagtaccttacgagggtacgggacggggtacctaattacccaacccacgtttacccgaaccgaacggaacgaaccccgaaaacggtaacccgtaaagtaaccctacgttaacgtacgttactaacgtaggaaacctaaacgtaccgaaaccgactacccggtaggaaaccgacgggtaccggaaaccgggtaccaacccgggtctttagggttattaccgtttacgggacggttaacggcccggtaaacggaccccttcccccccggactaaccccggtaac

SEQ ID NO: 281472 - DNA, 615 bp, Homo sapiens
  misc_feature: GYAE6OF01CGS4H.37.51.E07.1.454.CMB.1.raw
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
  modified_base (602)..(602): a, c, t, g, unknown or other
  misc_feature (602)..(602): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagccgtggtcaaggccgtgggggacgtccctggagactctccgtgtcgcagccctgtggactttcacctttnagtnctatagcatgacgtcgggccnccgaggctcggaggggacgggctagggagttcgggtctacgatcctaagtttacgtaggtagttggttaacttacaagttactaacgtacgtcaacgtactcgaggttcgggaacgggggacctagttaccaaccctacgtcctaccgaaggaccgaacgaaacccgaccgaaaacgaaccttacgaaccgttagttaactctacgaactaaactgaacctagccgtagaaccgacgccggaagtacncggtntaggttagttaacttcgtgcggacgacgaccnccctcgacctcgg

SEQ ID NO: 281473 - DNA, 649 bp, Homo sapiens
  misc_feature: GYAE6OF01BFIWU.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagccgtggtcaagccgtggggacgtcccgtgagactctcttgtgcagcctctggacttccaccttcgagtagcttaatacgcagtgtaacgtcgggtacccgccgaggcctaccggaaggggaacggggcgtagggtaggttcgggtctacgacgttccgtaagtttaggtaggttacggttacggttaacctttaacgattaactacgtacggcaagtacctcgaggtcgggacgggcctattccacctatcctacagacgaccgaacgaccaaacgtacctcacttacgtactcgtaacgaactaaagtacgaaacgacgtacgtaggaacggtacggaccggaacggaaccggtacgggtcttagggttacgttacgttacggttaggtacgacgacggtacccgtcccccgtacccgccgtaccg

SEQ ID NO: 281474 - DNA, 677 bp, Homo sapiens
  misc_feature: GYAE6OF01DW734.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgcttattttagaaggtgtccagtgtgaggtgcagcgtggtggagtcgtgggggacgccgtggtcaagccgtggggacgtccctgagactctcctgtcgcacgcctctggtatttctaacgttttcggtagcttagttggagtggacgttcgggtcccgccacgttcctaccggaggggaaggggcgtaggaggtgggtcggccaaacagtacggaggggaggtggtaggtaacgaaaaacgtgtaggtaggactcgtggtcggccggggtccgtagttccacctagtcctaccgaagacgaccaacgaaccaaaacctcgaacttgtactcgtacgacgtaaagtcgggaacggccgtaggacgtaacggtacccggaacgggaccgtaccgggtacgttacggttagttaagtttacgtttcgggtagtaacgggtaaggtagttaacgtttaaggtaacctttaaaacgttaacggttttacggaagtttacgaacggtttggttaag

SEQ ID NO: 281475 - DNA, 788 bp, Homo sapiens
  misc_feature: GYAE6OF01E40NA.37.51.E07.1.454.CMB.1.raw
  modified_base (219)..(219): a, c, t, g, unknown or other
  misc_feature (219)..(219): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccagtggactggggctccgtcgttgggttttccttgttgcttaattttagaggtgtccagtgtggaggtgcagcgtggtggagtcgngggggagcctggtcaaggccgtggggactcccgtggacgaccttctccgtggtcgcgacggcccttcgtaggtactttccgaaccctttgagttacggtcctaagtacggctaagtacggtaaaccgttccggggtacccgcccgaagggtccctccggaaagggggacggggtcgtagggtacggtcggggttacctccgtaagttacccctaagtttaaacggtaggttaagtttaccggttaaacctttaccgaatttaaccgttaaaccgtacggaccgtaaacggttaccgtaaccggtaagggtacggggaaccggggttaccctaacgtttaccccgaaacccggtactttcccgtaacccggtaaggaaccgtaaccccggaaacgtacccgaaaacgtaacctctaaccgttagtaaccttcgaacgaaacgtaacttacgggaactaccgtcgtaaggacgaaccggtacccggaagggtaccgaccgggtgttaggtacgttatttccgggagtcgtaaccgtacggaaccccgttcccccctaacgtacccggtacg

SEQ ID NO: 281476 - DNA, 736 bp, Homo sapiens
  misc_feature: GYAE6OF01BR2H8.37.51.E07.1.454.CMB.1.raw
  modified_base (168)..(168): a, c, t, g, unknown or other
  misc_feature (168)..(168): n is a, c, g, or t
  modified_base (527)..(527): a, c, t, g, unknown or other
  misc_feature (527)..(527): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttcctgttncttattttagaaggttgtccagtgtgaggtgcagtcgtggtggaggtcggtgggggacgtcccgttggtacgaaggtcccgtagggggtaccttcccgtaggacgtaccttcgtccgttggtcgcacggtccttacgtgtacttccactttcgagtactctaacgtcgactaggtacggaaccggttccgggtacccgacgtacggccgtaaccgggtaagggggacggttccgtaggggacgtttcgggtacctacgtaacttccggttaaagttacggttagttacggttacgttaactaataacgttactaccgtacgacaagtctagtagggtggacggtctaagtccaacgtcncgtaacgacggtacgaaccaaaccgtaccaaacgtacctacgtacgttactcgtaacgtaccgaacgtaaacgtccgaaacgtctaccgggtagaaccggacggaaaccggtacgggaacgttccgggtacgttaaggtttaccggtaacgttaccggtacggacggtaccgtaaccggcccccttaacccgtacccgagtaacccggg

SEQ ID NO: 281477 - DNA, 722 bp, Homo sapiens
  misc_feature: GYAE6OF01BRN6A.37.51.E07.1.454.CMB.1.raw
  modified_base (340)..(340): a, c, t, g, unknown or other
  misc_feature (340)..(340): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcgttgggttttccttgttgcttattttagaggtgtccagtgtgaggtgcagtcgtggtggagttcgtgggggacgccgttgggtcgaaggccgtgggggacgtcccgtgacgtacctcgtccgtgtcgcacgcctcgtaggtcttccaccttgaagtcgctagtacgctagtacgtaacgtcgggtccncgtacgcctacggagggacgggcgtggtagtgggtctcgtacgtacgtagttaggtacgtaggttacggtaacttaacgtagttaactacgtaaccgcgaagtacctaggacgggtacgggacgggtaccgtacgtccaacctagtacccgtaccgaagaaccgggaaccaaaccgaaccgtaaacgtaacctaccgtaatttacggttaacgtcttaacggaacttaaagaccggaaactacggtacccgagggtaacggaccggaccggaaagggtacccgtaagggtccgtttaggtttaacggtttaacccgttacgggttacggtaacggtaccggtaacccggtaccccgtccccggtaaccctacccggtacccg

SEQ ID NO: 281478 - DNA, 721 bp, Homo sapiens
  misc_feature: GYAE6OF01AKOHG.37.51.E07.1.454.CMB.1.raw
  modified_base (688)..(688): a, c, t, g, unknown or other
  misc_feature (688)..(688): n is a, c, g, or t
  modified_base (712)..(712): a, c, t, g, unknown or other
  misc_feature (712)..(712): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggacttcaccatggacgtgggctccgtcgttggttttccttgttgcttattttagaaggtgtcagtgtgaggtgcagcgtgggtcggagtcgggtgggggacggtccgtgggtaccgaacggtccggtgggggtaccgtcccgtaggacgtaccttcctccgtggtcgacgacgtccttcgtacggtactttccctaccgttcgagtacgtactagtagcctaggtaccgtaacggttccgggcccgaccggtacggtacccgtaccgggtaaggggggtacggggtcgtaggggtacggtcgggtactacgtacgttaccgtaagtttaggtagttacggtacgttaactaactaagtactacgtacgactaacgtctacggtaggtacgggaccgggtacctattacccgtacctctaccgacgaacggaaccaaccgaaccgacccaaagtaccctacgttacgtacttacgtccaacgtaactaacgtaccgaacgtaccgaccgtagaacggaccgggacgtaacggaccgtaccggtagttcgttaacgtgttacgnggtaccgacgtaccacccgtcccncaccgtacg

SEQ ID NO: 281479 - DNA, 606 bp, Homo sapiens
  misc_feature: GYAE6OF01EIXV9.37.51.E07.1.454.CMB.1.raw
  modified_base (152)..(152): a, c, t, g, unknown or other
  misc_feature (152)..(152): n is a, c, g, or t
  modified_base (287)..(287): a, c, t, g, unknown or other
  misc_feature (287)..(287): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (554)..(554): a, c, t, g, unknown or other
  misc_feature (554)..(554): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgntgggttttccttgttgctattttagaaggtgtcagtgtgaggtgcagctggtggagtcgtgggggagcctggtcaagccgtgggggactccctgagactctcctgtgcagcctcgtggtattcaccttcaggtanctatagcagtcgaacgtgggtcccgccgaggcctaccgaggggaacggggtctagggaggtgggtcctacgactaccgtagttaggtacgttaggtggttaccttaacgattactacgtacgctaagacttcgaggtggacggggtaccagtttaccaccgtatcctacgaaggacgaacctaaccgaccaaacgaactctaaccgtnttacnctacgactaaagtccgaaacagcctaggaagacggaccgtaggaccgaccggtnttaggttattacgttacgtggacggtacgacgaccgcccctccgaccgtacg

SEQ ID NO: 281480 - DNA, 608 bp, Homo sapiens
  misc_feature: GYAE6OF01DCCE9.37.51.E07.1.454.CMB.1.raw
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
  modified_base (596)..(596): a, c, t, g, unknown or other
  misc_feature (596)..(596): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaaggcctggggactccctgacgactctcctgtcgcagtcctntggtacttccgaccttcagtagctatgcatgacgtggtccncgaggctcggagggacgggctgggacgtcgggtctacgtactccaagtttacgtagtacgtagttacttactagtactacgtacgctaacgactcgaggttacggacggggtaccgtattaccgacctatacctaccgagacgaaccgtaaccgaccaaacgacctacgtacgtagttactactacggaactaacgtagaacgtacgccgtagaacggtaccgacggacggtacgacggtcttaggtagttacgttaccgtgtaccgacgtacgacccgtaccccncgtaaccctacg

SEQ ID NO: 281481 - DNA, 791 bp, Homo sapiens
  misc_feature: GYAE6OF01BYE01.37.51.E07.1.454.CMB.1.raw
  modified_base (198)..(198): a, c, t, g, unknown or other
  misc_feature (198)..(198): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgctattttagaaggtgtccagtgtgaggtncagcgtggtggagtcgtgggggacgtcctggtcaagccgtggggacgtccctgacgtactccgtccgtgtcgcgacgtccgtgtacgtacttaccgtaccttacgagtacgtacgtagtacgtactacgtacggtaccggtccggtccgaccgacggtccgtacggggaaggggttaggggttacggtacggttcggtacctacgtacgttacgttaagttttacggttaaggtttacggttacgttaactttaacgtaacgtttaacgtaaccgtaacgtacgtaacgtaccgtacggtaacgggtacgggtaccgggtaccttaacgttaaccgacccgtaacttacccgtaaccggaacgaaccgtaacccgtaaccgtaaaccctaaacgtaaccgtaccgttaacgttacgttaccgtacgtactaaccgtaaggtacgtaaccgtaccgtaccggtaacggaaccggtaccggaccgggaacgggtacccggtacggttaccggttaggtttacgtttaccggttacggtacggccggtaacccggtacccggtacccgttaccccctaacccgtaccggtacgacg

SEQ ID NO: 281482 - DNA, 792 bp, Homo sapiens
  misc_feature: GYAE6OF01CZ2P0.37.51.E07.1.454.CMB.1.raw
  modified_base (676)..(676): a, c, t, g, unknown or other
  misc_feature (676)..(676): n is a, c, g, or t
  modified_base (755)..(755): a, c, t, g, unknown or other
  misc_feature (755)..(755): n is a, c, g, or t
  modified_base (762)..(762): a, c, t, g, unknown or other
  misc_feature (762)..(762): n is a, c, g, or t
tcagtagtgtagatcacgaccggtgctcgatttagcatactctacaacacacaaaggggctgagagaggagccttagccctggattccaaggcctatcccacttggtgatcagcactgagcaccgaggattcaccagtggaacgtggggctccgtcgttcgggtttttccttgttgtacttattttaggaaggtcgtccagtgtgaggtgcagtcgtgggtggagttcggtagggggacgtccgttggtacaacggtccggtagggggactcccgtaggacgtaccttcctaccgtggtacgccacgtccctcgttacggtaactttccctaccgtttacgacggttacgaccttaagtacgacctagtacggtaaccggttccggggtaccccgacccggacgggtacccgttacccggggaaaggggggtaaccggggtccggttaggggtacggtttaccggggttcctacgtaacgttcccgttaaaggttttacgggttaaggtttaccggttaggtttaaaccttaacgttaacttaaccgtttaaccgtaccggtacctaacggtacgttacggtacgggttaccgggacggggtacccttaacttacccgacccttagtaccctacggaacgaaccgtaaccgaacccgaaccgtaaacgacccttanaccgttagttactacgtacgaactaacgtacgaacgtcgtacgtagaacgacggaccgagccgtacggtgtagttattntcggtancggtacgaccgcccgaccctctacccgtcg

SEQ ID NO: 281483 - DNA, 749 bp, Homo sapiens
  misc_feature: GYAE6OF01A51EU.37.51.E07.1.454.CMB.1.raw
  modified_base (379)..(379): a, c, t, g, unknown or other
  misc_feature (379)..(379): n is a, c, g, or t
  modified_base (605)..(605): a, c, t, g, unknown or other
  misc_feature (605)..(605): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggactgggctccgctgggttttccttgttgcttattttagaaggtgtccagtgtgaggtgcagcgtggtcgggtaggtcggtggggggagccgttcgggtacaacggtccgttggggggacgttccccgtaggacggtacctccgttccgtggtcggcacggtcccttcgtcggtaactttaccctacctttacgagttaccgacttaacgtagaccagtacggtaaccgttcgggggtcccnccggacggccgtaccgggaagggggtaacggggcgttaggggaggttcgggtccttacgactccgtaagtttaacggtaggtttaaggtcggttaactttaacgaatttaacgtacgtacgacgtaacgacctggacggttacgggaacggggtcctaagttcccgacctaacgtcctaccgaagtaaccgacgtaaccgacctaaacgtaccgtacctacggttntaacgttctaacggaacttaaacgacgaacgttacgtaccggagtaaccgggacggaacccggtaggaaccggtacgtcgtgtttaacggttacttacggtaggtcccggtacgaacggtaacccctcccgtccccgactacgg

SEQ ID NO: 281484 - DNA, 773 bp, Homo sapiens
  misc_feature: GYAE6OF01ES9NE.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccagtggaacgtggggcctccgcgttgggttttccttgttcgcttagttttagaaggttgtccgagttgtggaggtgcagtcgtagggtggagtcggtggggggacgtaccgtgggtacgaacggtccgtagggggacgtcccgtaggacgtaccttctccgtggtcgaccgacgtcccgttcgtgggttacttccgacccgtttaacgacgttaggaccttaagttacgcgtaagtcgtaaacggtccggggtccctaccgacggacctaccgggagggaacggggtctacggggtagtcgggtctacgacgtccgttaagttaggtacggttaggtacggtacctacgaacttaagtaacgtaaccgtaccgacgtacgtaccgttacgaagggttcgggacggggacccggttaacttaccccgaaccgttacgttacccaaccgggaagaacccgtaaccaacccgggtaaccaaaccggtactacccgtaacgttacgacctttagaccgtaataaaccgttagaaccgtcgtaccgaggaaggtccggacggtagggaacccgtcggttagtacggttacttacgtttacggacgggtacgaacgaccgttacccccggccctaacccgtacccg

SEQ ID NO: 281485 - DNA, 747 bp, Homo sapiens
  misc_feature: GYAE6OF01EROSE.37.51.E07.1.454.CMB.1.raw
  modified_base (152)..(152): a, c, t, g, unknown or other
  misc_feature (152)..(152): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgnttgggttttccttgttgctattttagaggtgtccagtgtgaggtgcagtcgtgggtggagtcggtggggggagtccgtgggtacaggccgtggggactccctgacgacctctccgtgtcgcacgccttctggtactttccacctttcgaacgttagccttaagtacggcagttcggtaacggttcggggtcccgaccgacgggtcccgtaccggaaggggggaacggggtcgtaggggtacggttcggggttcctacgtaacgttccgtaagtttaaggtaggttaggtacggtttaacttacaattactacgtacgacacgtactacgtaggtcggaaccggggtcctagtttacccacctactaccgacctaaggacgaacccaacggacccaacgtaacctctaaccgttgtaacgtctacggaactaaacgtacggaaccacggtaccgtaggaacggaaccgggtaccggaacggtaaccggtaaccgggtcgtttaagggttacgttttaaacggttacccgggttagggttaccggaaccgggtacccggaaccccgttccccccgttaacccgtacccggaacccgg

SEQ ID NO: 281486 - DNA, 807 bp, Homo sapiens
  misc_feature: GYAE6OF01BRD85.37.51.E07.1.454.CMB.1.raw
  modified_base (150)..(150): a, c, t, g, unknown or other
  misc_feature (150)..(150): n is a, c, g, or t
tcagtagtgtagatcacgaccggtgctcgatttagcatactctacaacacacaaaggggctgagagaggagccttagccctggattccaaggcctatccacgttggtgatcagcactgagcaccgagattcaccatggactgggctccgngttgggttttccttgtgtcttattttagaggtgtcagtgtgaggtgctagcgtggtggagtcggtgggggacgccgtggtaccaaggccggtggggtactcccgtggacgtaccttcgtaccgtgtcgccgacggtcccgttgtcggtacttcctaccttacgaggttaccgactagtacgactacgtacgtaaccggtccggggtcccacgtacggtccgtaccggggaagggggacgggtcgttagggacggttcgggtactacctacggtactaaggtttaggttaacggttaggtccgtttaacttaacgtaacgtacttaccgtaacgtacaacggtaccgtaggtacgggttacgggtaaccggggtccttaagttaccccgaaccctacgttacccgtaccgaaagtaaccggaacccaacccggtaacccgtaaactaccggtaccttacgggttactacgtacgtaacgaaacccgtaaagtaccggaaaccgtacggtcccgaagggaaccgggtacccggaaccgggtaaaccggaccgggttaccgggttcgttaaccgggtttaatttacccgggtaggttaacggccggtaaacccgggtccctaaacccccggtccccccgttaacgtcccccggtaacggg

SEQ ID NO: 281487 - DNA, 844 bp, Homo sapiens
  misc_feature: GYAE6OF01DL4ZN.37.51.E07.1.454.CMB.1.raw
tcagtagtgtagatcacgaccggtgctcgatttagcatactctacaacacacaaaggggctgagagaggagccttagccctggattccaaggcctatccacgttggtgatcagctacgtgagcaccgaggattcaccagtcggaacgtggggcctcgtcgttgggttttcctgtgcttatttagagtgtcagtgtggaggtgcgtagcgtgggtggtagtcggtagggggacgtccgtggtacgaagtccggtggggactcccgtggactaccgtctccgtgtcgactcggtctgtacgtacttcctaccgtttgaggttacacgttaagtaccgtacacggtacggtaacccggttccgggtacccgccgttaacgggcccttaacgggggaaacggggtacggggtcgggtaacggggttaccgggtcgggttaacctaccgtttaacgtaacctttaacgggttttaaagggtacggtttaacgggtttaaccgttaaccgttaaacgtaacgtttaaaccgtttaaaccggaccgttaacggacggttacccgttaaggacggggttaccggggtaccggtaccgttacctaccgtaccgtacttacgggaccgtaaacgacgtaaaccgaaaccgtaaccgtaacgtaacccttcgtaattaaccggttactaccggtaacgaacgttaaagttaccggaacgtaccgttacgaacgggaacgggtacccggaccggaaacgggttacccgacgttacggtttaccgtagtttaccggtttacggagggttacccgacgggttaacccgtccccgacccttaaccccggaatccccggg

SEQ ID NO: 281488 - DNA, 815 bp, Homo sapiens
  misc_feature: GYAE6OF01DBJZW.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagccacgaggattcaccatggaactggggcctccgtcttgggttttccttgtgcttattttagaaggtgtccagtgtgaggtcgcagctgggaggagttcggtgggggacgcccgtggtaccaacggtcccgttgggggacttccccgtaggaagcctcttccgtggttcgccacggtcccttcgtaggtactttcccgaccttttcgaacgttaggaccttagtacgactaagttacggaaccggtttcggggaccccgaccggtacggtacgttaccccggggaagggggtaacggggtccgttaggggaaccgggtttcgggttacctacgattcccgtaattttacgggtagttacgtacggttaccttaatacgtatttaaacccgcgtagacgacgttacgagggttacggtacggggacccttagttacccaaccgttacgttacccgaacgacgggaaccaaaccgtaaacccggaaccgtaaacgtacccgttaacctacgtttacgtacctacgttacgggaaaaccttaaagccgtaaaccgtacggtaaccgttagggaacgacccgggaccgggtaacggtaacccggacggttaacccgtttaggttacggtttaccgttaaacgggttcgtacgggtacccgttaaacggccccggttaccccctaccgtaccccggtaaacg

SEQ ID NO: 281489 - DNA, 778 bp, Homo sapiens
  misc_feature: GYAE6OF01C02O1.37.51.E07.1.454.CMB.1.raw
  modified_base (147)..(147): a, c, t, g, unknown or other
  misc_feature (147)..(147): n is a, c, g, or t
tcagtagtgtagatcacgaccggtgctcgatttagcatactctacaacacacaaaggggctgagagaggagtcctagccctggattccaaggcctatccacttggtgatcagcactgagcacgagatcaccatgacgtgggctccgngttgggttttcctgttgtcttattttacgaagtcgtccagtgtgaggtgcagcgtggtggagttcggtcgggggagtcccgtggtacgaacggtccgttggggactcccgtaggtaacgcctttctccgtggtaccgcgaccgtcctacggtggtaaccttccaccgttcgaagttcgaccttaagtacggtactacgtaacggtaaccgtcgggggtaccccgaccgacgggtccgtaccgggaaacgggggtaacggggtcgttagggggacggtttcgggtacctacggtaccttaacgtaagttttaacgggtagtttacggtacgttaaccttaagtaacttacgtaacgtaacgtacgtaaacggtcccgttagtaacggtacgggtaaccgggttacccgtacgtaacccgtacgttacccgtacggtaaacggtaaaccggttaacctaacccgtaaacggtaacctaaccgttacgttccggttacgttacgtacgtaactaaacgtacgtaacgtacgccgtaggtacgacggacggaacgtacgaccggttactaacgttagtacgttaggtcggtacggtaacgtacgtacgttacccgtactacgtcgtggtacccgg

SEQ ID NO: 281490 - DNA, 815 bp, Homo sapiens
  misc_feature: GYAE6OF01DX4Y1.37.51.E07.1.454.CMB.1.raw
tcagtagtgtagatcacgaccggtgctcgatttagcatactctacaacacacaaagggctgagagaggagccttagccctggattccaagcctatccattggtgatcagcactgagcaccgaggattcaccatggaacgtggggcctccgtcgttcgggttttccttagttgtacttattttaaggaaggttcgtaccgtaggtgtgaggtgcgtagcgttgggtggacggttcggtacgggggaggtcccgttggttacctaacggtcccggtaggggtaccgttccccgtaggacgtaccttccgtccgtggtcgaccacgtcccgttagtcggtactttacccgtacctttacgagttacgtacttagtaacgcttaagtcggtaacgttcgggtccccgcgtaaccggtccgtaacccgggaaggggttacgggtctgggtacggttcggctcgtactcgttaagttaggttacggttagttcgggttaactaacttagttaaccgtagttaaccggcttaacgggtacctaacgggtagggtacgggtaaccggggtaccgttaacgttacccgaaacgttccgtacggtaaaccgaacggtaaaccgtaacccggaaacccggaaaccgtaaaccgtaaccgttacctaacggttacgttaacgttaaccgaaggttaacaacggttaacgacgtacgtaccggtacggaacggtacccgacgggtaccgtaacgaccggttagtacggttactttccgaacgtggttaccggacgtacccgtaccgtaccccctacgtcccgtaccgg

SEQ ID NO: 281491 - DNA, 843 bp, Homo sapiens
  misc_feature: GYAE6OF01DALFH.37.51.E07.1.454.CMB.1.raw
  modified_base (155)..(155): a, c, t, g, unknown or other
  misc_feature (155)..(155): n is a, c, g, or t
tcagtagtgtagatcacgaccggtgctcgatttagcatactctacaacacacaaaggggctgagagaggagccttagccctgattccaaggcctatccacttggtgatcagcactgagcaccgaggtattcaccagtagggactggggctccgtnttgggttttccttgtgtcttattttaggaaggtcgtcaggtgtggtaggtgcgtacgcggttgggtacgggagttccgggtagggggggacggtcccgttagggtaccgaaccggtccgggttacgggggtaccgttcccgtaggtacgtacctttccgttaccgtgtcggctaccgtccgttcgttagtacctttctacctagtacgtaagacttatacgtagtagtacggaaccggtcgggtccgaccgacggtcgtacggaacggggaagggtccgtagggtaccggtcgggtcctagtacttaaccgttagtttaacggtaggttagtttaacgtttaacacgttaaccgttacgttaacgacgtactacggtaccagggtaaggtccgggacgggttacccttacccgtaaccacgttccgttaacccgagaaccgtaacccgggaacctaacccggtaacccaaaagttacccacgttaccttaagtctaacgtaactaaaacgaacgttaacggaaacgaccggtttaaccggacgggtaacggtaacccggggtaaaccgaccgggttaaccccggaggtttacgttacggttttaacccgttaggttaccgggttgggtaaccccggtaacggacccccgtttacccctaacccccgggtcccaacgttaaaccccggg

SEQ ID NO: 281492 - DNA, 1095 bp, Homo sapiens
  misc_feature: GYAE6OF01EYSTI.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccagtggaacgtggggctccgcgttcgggttttccttgttgcttagtttttaggaaggttgtcctaggtgtggaggtgacaggtcgtgggtgggtacggtcggtggggggacggtccgtgggtacgaacggtccggttggggggtaccttcccgtggaacgtaccttccgttccgttggtcggacccgtacggtcccgttacggtacggttaaccgtttcccttaacccgtttacggaacggtttacggtaacctttaagttaccgggaccgttaagttaccggggtaaaccggggtttccgggggacccccggtacccggtaaccgggggtaccggtaaccggggggaaacgggggggtaaaccggggggttcgttaacgggggggttaaccggggtttcggggttaacccctaccggttaaaccgtttaccccggtttaaaagggtttaacgggtttaaggttacggggttttaaacggttaacctttaaacgtaactttaaccgtaaacccggtacggtaaccgaacggttacccgtaacggtagggggttaaccgggggtaacccgggggtaccctttaacggttacccctaacttaaccgtacccttaaccgggtaaaccggaaccggtaaacccggaaccccggtaaaaccgtaaaccggttaaacccttccgttaacgttaccgttaacgttaaccgtaaacggaaaacccttaaaggggttaaccgtaaacccggtacgggttaaccccgggtaagggaaaccgggtaaccccgggggtaaaccgggggaaaaccccggttacccggggtaaaccggggttttaccggtttaaacggggtttaaacggtttttaccggtttaaacccgggtacgggggttaccccgggtaaaaccggggttaccccggtaacccccccgttccccccgtaaaccccgtaccccggtaaacccggg

SEQ ID NO: 281493 - DNA, 497 bp, Homo sapiens
  misc_feature: GYAE6OF02IU52P.37.51.E07.1.454.CMB.1.raw
  modified_base (338)..(338): a, c, t, g, unknown or other
  misc_feature (338)..(338): n is a, c, g, or t
  modified_base (461)..(461): a, c, t, g, unknown or other
  misc_feature (461)..(461): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggagtccctgagactctcctgtgcagcctctggattcaccttcagtagctatagcatgaactgggtccgccaggctcgagggaaggggctggagtgggtctnatccattagtagtagtggtacttacatatactacgcagactcagtgagggccattcacatctccagagacaacgcaagaactcactgtatctgacaaatgaacagcctagagagccgaggacncggctgtgtattcgtgtgcgagacgccctccacctc

SEQ ID NO: 281494 - DNA, 499 bp, Homo sapiens
  misc_feature: GYAE6OF02GSDRF.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggagtccctgagactctcctgtgcagcctctggattcaccttcagtagctatagcatgaactgggtccgccaggctccgagggaaggggctgggagtgggtctcatccattagtagtagtggtacttacatatactacgcagactcagtgaggggccattcaccatctcagagacaacgccaagactcactgtatctgacaaatgaacagcctgagagccgaggacacggctgtgtattacgtgtgcgagacgccctccacctc

SEQ ID NO: 281495 - DNA, 815 bp, Homo sapiens
  misc_feature: GYAE6OF02GT5BC.37.51.E07.1.454.CMB.1.raw
  modified_base (701)..(701): a, c, t, g, unknown or other
  misc_feature (701)..(701): n is a, c, g, or t
tcagtagtgtagatcacgaccggtgctcgatttagcatactctacaacacacaaaggggctgagagaggagccttagccctggattccaaggcctatccacttggtgatcagacactgagccaccggaggtattccaccagtaggaacggtggggcctccgtcgtttcgggtttttcctttggttcgtacttttaagtttttaagggtaagggttcgtaccgtaggttggtaggtagggttgacgaggtcgttgggtgggtacgttcgggtggggggacggtccgttgggtacgaacggtccggtagggggaccgttcccgtaggacgtacctccttccgtggtcgacgacgtcccttcgtggtactttcctaccctttacgaaggtacgtacttaagtacgactagtacgaacggttcggggtcccgaccgacggtcctaccgggaagggggaacggggtcgtagggtagggttcggggttcctacgtactaccgtaagtttaggtaggttaggttacggttaacttaactattaacttaccgtacggaccgaacgtaccgtacgtagggtacggggacgggggtaccttacgtttacccgaacctacttcccgtaccgaaggtaaccgaaccgtaaacccgacccgaaacgtaacctacctacgttacgttacttcgtacgaactaaagtacgaaaccncgtaccgtagaacgaccggaccggacgggaccgaccgggtcgttaggttagttaacctttacggttaggtacggaccggtaacgtaccccgtacccctacccgtaccgtaccgg

SEQ ID NO: 281496 - DNA, 528 bp, Homo sapiens
  misc_feature: GYAE6OF02GVMCU.37.51.E07.1.454.CMB.1.raw
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
tcagtagtgtagatcacgaccggtgctcgatttagcatactctacaacacacaaaggggctgagagagggagccttagccctggattccaaggcctatccacttggtgatcagcactgagcaccgaggattcaccatggaactggggctccgctgggtttccttgttgctattttagaaggtgtccagtgtgaggtgcagctggtggagtcgtgggggagcctggtcaagccgtgggggactccctgagactctcctgtgcagcctcgtggattcaccttcagtagctatagcatgaactgggtccgccaggcctcgaaggggacgggctgggagtgggtctcatccatttagtagtagtgtacttacatatactacgcagactcgaggtggacggggccattccacctatctaccagacgaaccaacgaccaaagacctcactgtactctagacaaatcgaacngcctagaagacgccgaggcaggtggacttgtgttaacttgnggtgcgaggcctccctccaccg

SEQ ID NO: 281497 - DNA, 499 bp, Homo sapiens
  misc_feature: GYAE6OF02ICAEY.37.51.E07.1.454.CMB.1.raw
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
tcagtagtgtagatcacgaccggtgctcgatttagcatactctacaacacacaaaggggctgagagaggagccttagccctggattccaaggcctatcccacttggtgatcagcactgagcaccgaggattcaccatggaactggggctccgctgggttttccttgttgctatttttagaaggtgtccagtgtgaggtgcagctggtggagtctgggggaggcctggtcaagcctggggagtccctgagactctcctgtgcagcctctggattcaccttcagtagctatagcatgaactgggtccnccaggctccagggaaggggctgggagtgggtctcatccattagagtatggtactacntatactacgcagactcagtgaggggccgattcacatctccagagacaacgccaagaactcactgtatctgcaaatgaacagcctagagagccgaggacacggctgtgtattactgtcgcgagagccctccacctcg

SEQ ID NO: 281498 - DNA, 554 bp, Homo sapiens
  misc_feature: GYAE6OF02FNCLS.37.51.E07.1.454.CMB.1.raw
  modified_base (548)..(548): a, c, t, g, unknown or other
  misc_feature (548)..(548): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggatccctgagactctcctgtgcagcccctggagttctaccttcagtagcgtatagcatgaacgtgggtccggccacggctccgacgggaaggggccgtggaggtggggtcgtcactcctacttagtagtagtaggtacgttactagtatactacgcagactcagtgagggccggattcaccatctccagagacaacgccaagaacctacactcgtataccttgactaaagtacgaacacgacctgaacgagtaccgacggtacacggcgtcgtagtatttactagtggaccgagaccgccctcccgtaccncgtacg

SEQ ID NO: 281499 - DNA, 508 bp, Homo sapiens
  misc_feature: GYAE6OF02G8VGX.37.51.E07.1.454.CMB.1.raw
  modified_base (303)..(303): a, c, t, g, unknown or other
  misc_feature (303)..(303): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctgggggatccctgagactctcctgtgcagcctctggattcaccttcagtagctatagcatgaactgggtccnccaggctccgagggaggggctgggagtgggtctcatccattagtagtagtggtacttacatatactacgcagactcagtgagggcattcacatctccagagacaacgccaagaacctcactgtatctgacaaatgaacagtctagaagagtacgaggacacgggcaatgtaattacgtgtacgagagaacaggtacgtgggaccg

SEQ ID NO: 281500 - DNA, 527 bp, Homo sapiens
  misc_feature: GYAE6OF02FVRWQ.37.51.E07.1.454.CMB.1.raw
  modified_base (304)..(304): a, c, t, g, unknown or other
  misc_feature (304)..(304): n is a, c, g, or t
  modified_base (391)..(391): a, c, t, g, unknown or other
  misc_feature (391)..(391): n is a, c, g, or t
  modified_base (440)..(440): a, c, t, g, unknown or other
  misc_feature (440)..(440): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggagtccctgagactctcctgtgcagcctctggattcaccttcagtagctatagcatgaactgggtccncaggctcaggggagggctgggagtggtctcatccattagagtagtgtacttacatatactacgcagactcagtgacgggcattcacntctccagacgacaaccgcaagactcactagtacttcagacaaatgaacncgacctaggaagacgccggagaccgacggtctgttacgtaattaaccgtggttcggacggtaggaccggccccttaccgcctaccgg

SEQ ID NO: 281501 - DNA, 589 bp, Homo sapiens
  misc_feature: GYAE6OF02J07N4.37.51.E07.1.454.CMB.1.raw
  modified_base (306)..(306): a, c, t, g, unknown or other
  misc_feature (306)..(306): n is a, c, g, or t
  modified_base (555)..(555): a, c, t, g, unknown or other
  misc_feature (555)..(555): n is a, c, g, or t
  modified_base (582)..(582): a, c, t, g, unknown or other
  misc_feature (582)..(582): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggactcccgtgagactctcctgtgcagcctctggattcaccttcagtgctatagcatgaactgggtccnccaggcctccgaggggagggctgggtagtgggtctcgatccgtaattaggtaggtagttggttaacttacataactactacgcagactcgaaggtcggacggggtacctattaccacccgtatcccgtaccgaggaacgaaccaaaccggaccaaaggtaaccctcaacttgtaactcgtacgacaaaactgaaaccacgccctagaacggcgtaccggagaccgtacggctaggttagtaacttacgnggtacgcggaacgtaccgcccctaccncccgtag

SEQ ID NO: 281502 - DNA, 517 bp, Homo sapiens
  misc_feature: GYAE6OF02H3Z19.37.51.E07.1.454.CMB.1.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtagtgtagatcacgaccggtgctcgatttagcatactctacaacacacaaaggggctgagagaggagccttagccctggattccaaggcctatccacttggtcgatcagcactgagcaccgaggattcaccatggaactggggctccgctgggttttcctgttgctattttagaaggtgtccagtgtgaggtgcagctggtggagtctgggggagcctgggtccaagccgtgggggactccctgacgactctcctgtgcagcctctggattcaccttcagtagctatagcatgaactgggtccncaggctccgagggacggggctgggagtgggtctcatccattagagtagtggtacttanatatactacgcagactcagtgagggccattcacntctcaganacaacgcaagaactcatgtatctgacaaatcgaacacgcctgaagacgccgaggccaacggtctaggtacgttattacgtggtagcgaagcgaccccttccgaccctcg

SEQ ID NO: 281503 - DNA, 559 bp, Homo sapiens
  misc_feature: GYAE6OF02HMUF6.37.51.E07.1.454.CMB.1.raw
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaagccgtggggagtccctgagactctcctgtgcagcctctggattcaccttcagtagctatagcatgaacgtgggtccgcaggcctcgaggggaagggctgggagtgggtctcatcattagtagtagtgtacttacatatactacgcaagctgagtggagggcctattccacctatctaccgaganaacaacgccaaagacctcactgtactcgtagaacaaagtcgaaacncgacctaggaacgacggccgaaggaccgaccgggtcttaggttacgttaactttacgtggtacgtacggaagtacccgtccccctacccgacctaccg

SEQ ID NO: 281504 - DNA, 530 bp, Homo sapiens
  misc_feature: GYAE6OF02HBL3M.37.51.E07.1.454.CMB.1.raw
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggacgtccctgagactctcctgtgcagcctctggattcaccttcagtagctatagcatgaactgggtccgccaggctccgaggggagggctgggagtgggtctcatccattagagtagtggtacttanatatactacgcagactcagtgagggcatcacntctcaganacacgcaagactcactgtatctagacaaagtcgaacacgcctagaacgacgaccggaggaccacgggtctaggttagttaacgttacgtggtacgacggacggtaccgcccctaccgacctacgg

SEQ ID NO: 281505 - DNA, 517 bp, Homo sapiens
  misc_feature: GYAE6OF02H8SUJ.37.51.E07.1.454.CMB.1.raw
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctggggatccctgagactctcctgtgcagcctcgtggattcaccttcagtagctatagcatgaactgggtccgccaggctccagggaaggggctggagtgggtctcatccattagtagtagtggtacttanatatactacgcagactcagtggagggcctatcaccntctccaganacaacgaccaagactcactnatctagacaaatgaacacgacctggaacgaggaccgaggacgacggcttggtgtaacttacgtgtgacgaggaccgtccctacccacctcg

SEQ ID NO: 281506 - DNA, 796 bp, Homo sapiens
  misc_feature: GYAE6OF02IPQCJ.37.51.E07.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgctatttttagaaggtgtccagtgtgaggtgcngctggtggagtcgtgggggagcctggtcaagccgtggggactccctgacgactctcctgtgcagcctctggtacttcacctttcaggtagctatagcatggaacgtggggcccnccgaggcctaccggaggggaacgggggtcttaggggaggttcggggttacctcgacgttacccgtaagtttaacgggttagttagggtttcgggttaaaccttttaaacgtaacttaacgttaaacccgtaaccggacctaacggtaacccttacgtaacgggttggggaaaccggggggtccccgttaagtttacccgaaccctaattccccgttaaccgaagggaaccgtaaaccaaacccgggacccctaaaaacggtaacccttacgtaaccgtaggtttaaacttccgttaacggaaaccctaaaagtaccggaaaccgaacggttccccgtaagggaaccggggtaaacgacccggggaacgggtaacccggtaaccgggccggtttaacggttaggtttaaaccgttttacggtaggttaccgggtaaccggacgggtaccccgtacccccggttcccccgaacccgttaccgg

SEQ ID NO: 281507 - DNA, 684 bp, Homo sapiens
  misc_feature: GYAE6OF02IKUU5.37.51.E07.1.454.CMB.1.raw
  modified_base (271)..(271): a, c, t, g, unknown or other
  misc_feature (271)..(271): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgcttattttagaaggtgtccagtgtgaggtgcagcgtgggtggagtcgtgggggagccgtggtcaagccgtggggacgtccctgagactctcctgtgcagcctntggattcaccttcagtagctatgcatcgaacgtcgggtccgccaggcctaccggaagggggaacggggtcgtgggacggttgggtactcgacgtcctaagtttacggtaggttagttaggttacttacgattataccgtacgcgtaagtactcgtaaggtcgggacggggcccgtagtttacccacctactcctaccgagtacgaacctaacgaccaaagaccctactacgttagtacttccgtagaaccgtaaagtaccgaaaccgtacgtacccgttagggaaacggaaccgggacccgggtacgggaaacccggtacggggtccgtttacgggtttacgttaaccgttttacggtggttacgggaccgggaacggtaccccggtccccccttacccgtaccccgtaaccg

SEQ ID NO: 281508 - DNA, 501 bp, Homo sapiens
  misc_feature: GYAE6OF02GCDOR.37.51.E07.1.454.CMB.1.raw
  modified_base (303)..(303): a, c, t, g, unknown or other
  misc_feature (303)..(303): n is a, c, g, or t
  modified_base (443)..(443): a, c, t, g, unknown or other
  misc_feature (443)..(443): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggatccctgagactctcctgtgcagcctctggattcaccttcagtagctatagcatgaactgggtccncaggctccgagggaagggctggagtgggtctcatccattagtagtagtggtacttacatatactacgcagactcagtgaggggccattcaccatctccagacgacaacgccaagacctcactgtatctagcaaatgaacngcctagagagccgagacacggctagtgtattacgtgtagcgagacgccctaccactcg

SEQ ID NO: 281509 - DNA, 556 bp, Homo sapiens
  misc_feature: GYAE6OF02H0LQF.37.51.E07.1.454.CMB.1.raw
  modified_base (182)..(182): a, c, t, g, unknown or other
  misc_feature (182)..(182): n is a, c, g, or t
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
  modified_base (414)..(414): a, c, t, g, unknown or other
  misc_feature (414)..(414): n is a, c, g, or t
  modified_base (515)..(515): a, c, t, g, unknown or other
  misc_feature (515)..(515): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaggtntccagtgtgaggtgcagctggtggagtcgtgggggagcctggtcaagccgtgggggactccctgagactctctgtgcagcctctggattccaccttcagtagctatagcatgaacgtgggtaccnccaggctccgaggggaacgggctggagtgggtctcgatcctagttagtagttacgtggtacttacatatacacgcagactnagtgagggcgtatcgacatctcaganacaacgcaaagacctgactcgtatctagacctaaatcgaacacgaccgtaggaacgacgacccgagggaacctccgggacgttgtagttaacgtttaacgnggtacggtcgaaacggtcccgtcccttaccgaccgtaccgg

SEQ ID NO: 281510 - DNA, 601 bp, Homo sapiens
  misc_feature: GYAE6OF02JTA9U.37.51.E07.1.454.CMB.1.raw
  modified_base (169)..(169): a, c, t, g, unknown or other
  misc_feature (169)..(169): n is a, c, g, or t
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
  modified_base (424)..(424): a, c, t, g, unknown or other
  misc_feature (424)..(424): n is a, c, g, or t
  modified_base (493)..(493): a, c, t, g, unknown or other
  misc_feature (493)..(493): n is a, c, g, or t
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
  modified_base (583)..(583): a, c, t, g, unknown or other
  misc_feature (583)..(583): n is a, c, g, or t
tcagtagtgtagatcacgaccggtgctcgatttagcatactctacaacacacaaagggctgagagaggagccttagccctggattccaaggcctatccacttcggtgatcagcactgagcaccgaggattcaccatggaactggggctccgctgggtttccttgtgctntttagagtgtctagtgtgagtgcagctggtggagtcgtgggggagcctggtcagccgtggggactcctgacgactctccgtgtcgcaggcctctggactttccgaccttcgagttacgctagtacgcatgaaccgtgggtcccncgaggtcctccgaaggggtagggcctgggacggtgggtcnccgatccgtaagtttaggacgttagttcggtaactacgtaagtaactacttaccggcaagtacctgtaggnggaacgggcctagttcaccgtatcaccgaagacgaaccgacgtaaccaagaaccgtcacgtgttaaccncttagactaaattcgaactagcccgttagaacccggagcccggaagccgtaacggtcccttaagtactttacgngttacgngtaacggtnacggtacaggaacgttag

SEQ ID NO: 281511 - DNA, 536 bp, Homo sapiens
  misc_feature: GYAE6OF02GEDHL.37.51.E07.1.454.CMB.1.raw
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggatccctgagactctcctgtgcagcctctggattcaccttcagtagctatagcatgaactgggtccgccaggctccgagggaagggctggagtggtctcgtctatagnggaagtggtgcttanacaaactcgnagcctcgngaggcnctcacatctcaganactattaccaagacgcactctgtatctagacaaatnaacagtcctgacgtgaccgacggacgaccggacccttaatatttagttgtacgtaggaagttggggtagggggggtaggtgggggtaccttacgttccgg

SEQ ID NO: 281512 - DNA, 903 bp, Homo sapiens
  misc_feature: GYAE6OF02H5Q71.37.51.E07.1.454.CMB.1.raw
  modified_base (395)..(395): a, c, t, g, unknown or other
  misc_feature (395)..(395): n is a, c, g, or t
tcagtagtgtagatcacgaccggtgctcgatttagcatactctacaacacacaaaggggctgagggaggagccttagccctggattccaaggcctatccacttggtgatcagcactgagcaccgaggattcaccatggaactggggctccgcttgggttttccttgttgcttattttagaggtgtccagtgtgacgtgcaactggtggagtcggtgggggagctttggtccagccggtgggggtccctggacgacctctcctgtcgcacgcctcgtggtacttactaacgttttgggtagtcgttagttggtagtcgggacgttcgggtaccccgccgtacggttccttacccggagggggaagggggtctgggaggttcggggtagcccgaaanacgtacgtggggaggttgggtacggtaaacggtaaaaactgttaggtaggaacgttcgtacgggttcgggaccgggggacccgttacgtttacccgaacccgtaaccgtttcccgtacccgtaaagggaaaccgaaaccccgtaaaacccggtaaaccccgtaaaaaaaccgtttacccgtaaaaccgtttacgggttaaacctttacccgtaaaccgggtaaccgtaaaaacgggttttcggggaaccccggggttaaccccgttagggtaaacggttaacccggtaacccggggttaacgggaacccggttaaccggggttaccggtttcggggttttaaacgtttaacggtttttaacgttacgggttacggacgggtttaaacgggtagttttaaacggtttaaccgggttaacctttaaaacgggttaaaccgggttttttaccgggaaagggtttaccgggttaaccggtttaaggggtacgttacgggttagtttaccggg

SEQ ID NO: 281513 - DNA, 540 bp, Homo sapiens
  misc_feature: GYAE6OF02GK1RE.37.51.E07.1.454.CMB.1.raw
  modified_base (494)..(494): a, c, t, g, unknown or other
  misc_feature (494)..(494): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggagcctgggtcaagccgtggggatccctgagactctctgtgcagcctctggattcgacctttcagtagcttatagcatgaactgggtccgcaggctccgagggaacgggctggagtggtctcatccattagctagtggtacttacattaactactacggcaagtctcaagttcggaggggtcccatttccacctatccgttaccagacgtaaccgaacgccaaaggacctcacgtacgtatcgtagacaaagtgaacagcctgagacgacgaggaccnggctgtcgtaacttcgtagtcgcgacgacgcccttaccgacctacg

SEQ ID NO: 281514 - DNA, 531 bp, Homo sapiens
  misc_feature: GYAE6OF02GGW0G.37.51.E07.1.454.CMB.1.raw
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggatccctgagactctcctgtgcagcctctggattcaccttcagtagctatagcatgaactgggtccncaggctccgagggaagggctggagtgggtctcatccattagagtagtgtacttacatatactacgcagactcagtggacgggcattcacatcctcagagacaacgccaaagactcactgtatcngacaaagtgaacngtcctagaagacgaccggaggaccaacgggctacggttagtaactttaccgtaggttcgacggaagaccgcccccgttaccgaccctacg

SEQ ID NO: 281515 - DNA, 643 bp, Homo sapiens
  misc_feature: GYAE6OF02H2CRV.37.51.E07.1.454.CMB.1.raw
  modified_base (405)..(405): a, c, t, g, unknown or other
  misc_feature (405)..(405): n is a, c, g, or t
tcagtagtgtagatcacgaccggtgctcgatttagcatactctacaacacacaaaggggctgagagaggagccttagcctggattccaaggcctatccacttggtgatcagcactgagcaccgaggattcaccatggaactgggctccgctgggttttccttgttgctattttagaggtgtccagtgtgaggtgcagctggtggagtcgtgggggaggccgtggtcaagccgtgggggacgtcccgtgacgactcctcctgtgcacgcctcgtggtacttccacctttcgagtacgcttaatagctaagtgaacgtcgggtccgccgacggctcccgaggggaacggggtcgtagggaggtgggtcctcgactccgtaagtttacgtagtacggttggtacttanattaactactacgctagactcgaggtcggacggggtccgtatccgactactccgtaccagaacgaccaacgaccaacgaacctctactacgtatcgagacctaaagtacgaaccgacgacccgtaggacgtaacggaccggtacggaaccggtaccggtgttccggtttaggttaaccttttaacgtgggttcggaccgggaagtacccccgtaccccttaccccgaccctaacccgg

SEQ ID NO: 281516 - DNA, 594 bp, Homo sapiens
  misc_feature: GYAE6OF02HB7NR.37.51.E07.1.454.CMB.1.raw
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctggggatccctgagactctcctgtgcagcctcgtggacttcaccttcagtagctatagcatgaactgggtccncaggcctcgagggaaggggctgggagtgggtctcatccgattagtagtagtggtacttanatatacacgcagactcagtggacggggtccattcaccatcctcagagaacaacgacccaagacctcactacgtactctagaactaaagtacgaaaccgtacgaccgttaggaaacggacgtacccgggagggaacccgtaccggggtcgttacggttacggttaactttacggttcggttacggccgggaacggttacccgtcccccgttaccccgaacccgttacccgg

SEQ ID NO: 281517 - DNA, 639 bp, Homo sapiens
  misc_feature: GYAE6OF02JWAQX.37.51.E07.1.454.CMB.1.raw
  modified_base (584)..(584): a, c, t, g, unknown or other
  misc_feature (584)..(584): n is a, c, g, or t
  modified_base (594)..(594): a, c, t, g, unknown or other
  misc_feature (594)..(594): n is a, c, g, or t
  modified_base (623)..(623): a, c, t, g, unknown or other
  misc_feature (623)..(623): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggagcctggtcaagccgtggggacgtccctggacgtactctcctgtgcagcctgtggtacttccgaccttcagtacgtctatacgactagtcgaaccgtcgggtcccgaccgtacggtccgtacccggaagggggaacggggtcctaggggtaggtcgggtctacgcttaccgaagtttacgagttacgtggtacttacgataacgtactacgcacgtctcgtagtggacgggtccaattcactacttcgtaccgaagtaaccgacgtaaaccgcccgaaagtaacctacgtaactacgtacttccgtacgaactaaagttcgaaaccgtgtacccgtaggaccgacgaccggtacgacgtaccggngttaccggtnttaacttgtcgtcgaacggtaccgtaccnccccgttacgacctcg

SEQ ID NO: 281518 - DNA, 566 bp, Homo sapiens
  misc_feature: GYAE6OF02ID1Y8.37.51.E07.1.454.CMB.1.raw
  modified_base (193)..(193): a, c, t, g, unknown or other
  misc_feature (193)..(193): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgcttattttagaggtgtccagtgtgnggtgcagctggtggagtcgtgggggagcctggtcaagccgtggggactccctgagactctcctgtgcagcctctggattccgaccttcagtgctatagcatgaacgtcggggtccgccgaggctcccgaggggaacggggctgggagtgggtctcagtccattagtagtagtggttaacttacatatacgtacgcaagacctgagtggacggggcctattccactcgtcctcaagacgaaccaacgccaaagacctcactgtactcagcaaagtcgaactcgcctagacgacgccggtaacggacgtaccgggcttgtacgttacgtttacgtggtacggacgaaccggtacgcccctaccgtaccctaccgg

SEQ ID NO: 281519 - DNA, 623 bp, Homo sapiens
  misc_feature: GYAE6OF02IMIWL.37.51.E07.1.454.CMB.1.raw
  modified_base (223)..(223): a, c, t, g, unknown or other
  misc_feature (223)..(223): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (588)..(588): a, c, t, g, unknown or other
  misc_feature (588)..(588): n is a, c, g, or t
  modified_base (605)..(605): a, c, t, g, unknown or other
  misc_feature (605)..(605): n is a, c, g, or t
tcagtagtgtagatcacgaccggtgctcgatttagcatactctacaacacacaaaggggctgagagaggagccttagccctggattccaaggcctatccacttggtgatcagccactgagccaccgaggattcaccatggaactggggctccggctgggttttccttgttgcttattttagaaggtgtccagtgtgaggtgcagctggtggagtcgtgggggngcctggtcaagccgtggggactccctgacgtacctctcctggtcgcacgtcctcgttggactttccaccttcagtacgacctatagctagtaggaaccgttcgggtcccgaccgagggccgtaccggaagggggaacggggcgttagggaaggttcgggttactaccgtatacccgtaagtttacggtaggttagtacggttaacttacaattactacgtacgacacgtactcgagtcgggacgggctattaccacacttccacgacgtacaaccgacgaccaagacccttcatagtactcacgataaangaacngtaccngaacgtccgacggacgacgtacggcttaggtacctaagtttggngttcggaccaaggcccnccccttaccgacctacgg

SEQ ID NO: 281520 - DNA, 513 bp, Homo sapiens
  misc_feature: GYAE6OF02IM444.37.51.E07.1.454.CMB.1.raw
  modified_base (302)..(302): a, c, t, g, unknown or other
  misc_feature (302)..(302): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtctgggggagcctggtcaagcctggggagtccctgagactctcctgtgcagcctctggattcaccttcagtagctatagcatgaactgggtccnccaggctccgagggaaggggctgggagtgggtctcagtccatttacgtagtagtggtacttacatatactacgcagctcagtgagggccatcaccntcnccgagagacaacgccaagactcactgatctganaaatcgaacagcctagacgacgaccgagaccgacggctacgtagttacttacgtgtcgcgtacgcgccctcgacctacg

SEQ ID NO: 281521 - DNA, 782 bp, Homo sapiens
  misc_feature: GYAE6OF02HN7F2.37.51.E07.1.454.CMB.1.raw
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
  modified_base (774)..(774): a, c, t, g, unknown or other
  misc_feature (774)..(774): n is a, c, g, or t
tcagtagtgtagatcacgaccggtgctcgatttagcatactctacaacacacaaaggggctgagggaggagccttagccctggattccaaggcctatcccacttggtgatcagcactgagcaccgaggattcacatggaactgggctccgcttgggttttccttgttgcttattttagaggtgtccagtgtgaggtgcagcgtgggtaggagtcgtggggggacggtccgtgggtaccaaaggccgttagggggacgtcccgtaggacggtaccttctccgtggtcgacgacggtccttcgtgggtatttaccacctttcgaaggttacncttaagagcaatgaacgtcgggtaccnccgagcctaccgagggggaaggtcgtaggtaggtgggtcnctactctaaggttagtaggtaggtaggttaacctttagaaattacttaaccgtacgacgtaacgtacccgttagtaacgggttggggaaacggggggtcccctaaaactttttcccggaaacccctaaatttccccgtaacgaaacgggtaacgaaaaccccgaaaccggaaccctttaaaacggaaaccttccggtaaccttaggtttaactccgtaacgaaactaaaacggtcgaaaaccgtacccgttagacgggaaacggaaacggcccgggttaaaccgggaccgtaccgggtaccgttaggttagttaaaccttaaggtcgggttcggaaccggtacgggaacctttcccccccgttaccaaccccgttanaacccggg

SEQ ID NO: 281522 - DNA, 786 bp, Homo sapiens
  misc_feature: GYAE6OF02IAE6W.37.51.E07.1.454.CMB.1.raw
tcagtagtgtagatcacgaccggtgctcgatttagcatactctacaacacacaaaggggctgagagaggagccttagccctggattccaagcctatccacttggtgatcagcactgagcaccgaggattcaccatggaactgggctccgcttgggtttccttgttgcttattttagaaggtgtccagtgtgaggtgcagcgtggtggagtcgtggggagccgtggtcagccgtggggtactcccgtagacgacttccgttcctggtcgacgacgtccttcgaggttacttcctaacccttgtaaggttacgacttaagtaccgtatacgttaggtaacccggttggggtacccccgtaccggacgggtaccggtaccccgggtaaaggggggggaaccgggggtccgttttaagggggaccggggtttcggggttacctaccggtaacttacccggttaaagtttacgggtaagtttacgggttacggttaaaccttacgtagtttaacgtaccgtacgacgtaacgtaactcgaggttcggggaaccgggttctacgttaccaccctacgtcctaccggaagaacgaaccgaacgtaccaaaggtacctacgtaccgtacgttaacgtccgttaaccgaacgtaaaagttacggaaaccgtcgtacccgtaaggacgtaccgaaccgggttcggaacccggtcggtaccgttggttagtttaacggtaacgtttcggaggtacccggtaaacgggtccccctaccccgttaccccaacgtacccg

SEQ ID NO: 281523 - DNA, 580 bp, Homo sapiens
  misc_feature: GYAE6OF02GTYWC.37.51.E07.1.454.CMB.1.raw
  modified_base (182)..(182): a, c, t, g, unknown or other
  misc_feature (182)..(182): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactgggctccgctgggttttccttgttgctattttagaaggtntccagtgtgaggtgcagctggtggagtcgtgggggaggcctggtcaagccgtgggggactccctgagactctcctgtgcagcctcgtggattccaccttcagtanctatgcatgaactgggtccncaggctacgagggagggctaggagtgggtctcgatccattacgtagtagtggtacttanattatactacgctagtactcgaggtcggaggggccgtaattccgaacctatctaccgagaacgtacaaccgtaccaaaggtaccactacttagtacgttcgttacgactaaagtcgaacctacgaccgtagaacggacgaccggaggacaccgggtctggttagttacttacgtagtcggtacggtacgacccgtcccctacccgaccgtaccg

SEQ ID NO: 281524 - DNA, 751 bp, Homo sapiens
  misc_feature: GYAE6OF02JHQFN.37.51.E07.1.454.CMB.1.raw
  modified_base (234)..(234): a, c, t, g, unknown or other
  misc_feature (234)..(234): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggactggggctccgcttgggttttccttgttgcttattttagaaggtgtccagtgtgaggtgcagctggtggagtcgtgggggagctggtcaagccgnggggactcccgtagagactctcctgtgcagcctcgtggattccacctttcagtacgctaatcgctaagtagaaccgttcgggtcccgccgaagggtcccttaccgggaaggggggtaacggggccgttagggggtacgggttcggggtaccttacgacctttaccgtaagtttttaacggtaggtttaagggtttacgggtttaaacctttaacgtaatttaaaacgtttaacccgtaaccggtacgtaccggttaaaccgtacggttacgggttaacggggaccgggggggtaaccccttagtttaacccgaacccgttaacgtttccctaacccggtaacggaaaccgtaaccgaaacccgggaacctaaacggtaaaccttacctaaaccgtacgtttacctacgttaacggactaaacgtacgaaacgtcgacctaggaacgtacgccggagtcccgacggtcgtgttagtaactttgtagtcgacggtaccggacctcccctccaccgtacg

SEQ ID NO: 281525 - DNA, 970 bp, Homo sapiens
  misc_feature: GYAE6OF02H4MWH.37.51.E07.1.454.CMB.1.raw
tcagtagtgtagatcacgaccggtgctcgatttagcatactctacaacacacaaaggggctgagagaggagccttagcctggattccaaggcctatccacttggtgatcagcactgagcaccgaggattcaccatggaactgggctccgctgggtttccttgtgtctatttagagtgtccagtgtgaggtgacagtcgtgggtgggtaggtcggtggggggacggtccgtggtcaaacggtccggtcgggggaacgtccccgtaggacgtactccgtccgtggtccgcgacgtccgtcgtaggttacttcctaaccgtttacgaacggtacggtactttaacgaacggtacgtaagtaccgtaaccgggttagggacccgtaccggtaacgggacccgttacccgggaaagggggtaacgggggcgttacgggggtaacgtttccgggggtactttaccggaaccttacccggttaaaagttttaacgggttaaagggttaaacgggttacgggtttaaacccgttaaaacgttccgggttaaaactttaaacccggtaccgggttacccgaaaccggttaaccggttaccgtaaacggggttacggggtaaccgggggtaaccccggttttacccgttaaacccgtaaaccccgtaacttacccggttaaccccggaaaggaaacccgggtaaaccccgaaacccggaaccccgttaaaaacgaaccgtttaaacccgaaccgtttaacggttaaccgttaccgtaaccgttaaagtaaacccgtaaacgtaacccggtaaacccgttacccgggtaaagggaacccgttaacggggaacccggtaaccgggttaacccgtaaccgggtcggttaacggtttacggttaaacgtttaaccgttaagggtacccgggaggtaacccgggttaaccccgtacccgttaaccccctaccgttaaaccccggg

SEQ ID NO: 281526 - DNA, 925 bp, Homo sapiens
  misc_feature: GYAE6OF02I1Y0L.37.51.E07.1.454.CMB.1.raw
  modified_base (352)..(352): a, c, t, g, unknown or other
  misc_feature (352)..(352): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggtttcctgttgctattttagaaggtgtccagtgtgaggtgcagctggtggatcgtgggggaggcctgggtacaagccgtgggggatcccgtggagtacctctcctggtgcgacgtcctcgtagggtacttcctaacccttccgaggttaacggaccttacgtaggcctaaagttcggtaaactcggggggttacccnccgtaaccgggtaccgtacccggaagggggaaacggggggtccgttacggggaacgggttcggggtaacccgttccgtaaccgtacccgtaaggttttaacgggttaagggttttaaccgggtttaggggtttaaccttttaaacaaacgtttaacgttaaacccgtacgggtcctaaaacggtactaccgtaacgggtttacgggaaaccggggggtccggtaacgttcctaacccggttaagttccctaccgaaacggaacggaaaccgttaaaccggaccccgtaaaaagtaaccccgtacggttaaccctttaagggttaccttttacccggtaagtaaaccccggtaaaagttacccggtaaaacccggttaacggaccccgtttaaacgggaacgggaaaccccgggtaacccggggttacggggaaaaccccgttaaccgggggtacccggttttaaccggttggttaaaacccggtttttcccggggttaggttaacccggggtttacgggaaacccgggttaaccccggtaccccccgtttaccccgtaccccggtaaccccgg

SEQ ID NO: 281527 - DNA, 660 bp, Homo sapiens
  misc_feature: GYAE6OF02JVPO7.37.51.E07.1.454.CMB.1.raw
  modified_base (335)..(335): a, c, t, g, unknown or other
  misc_feature (335)..(335): n is a, c, g, or t
  modified_base (390)..(390): a, c, t, g, unknown or other
  misc_feature (390)..(390): n is a, c, g, or t
  modified_base (521)..(521): a, c, t, g, unknown or other
  misc_feature (521)..(521): n is a, c, g, or t
  modified_base (565)..(565): a, c, t, g, unknown or other
  misc_feature (565)..(565): n is a, c, g, or t
  modified_base (574)..(574): a, c, t, g, unknown or other
  misc_feature (574)..(574): n is a, c, g, or t
tcagtagtgtagatcacgaccggtgctcgatttagcatactctacaacacacaaagggctgagagaggagccttagccctggattccaaggcctatccacttggtgatcagcactgagcaccgaggattcaccatggaacgtggggctccgcttcggggttttccttggttgtcttattttggaaggtgtccagtgtgaggtgcaagtggtggagtcgtgggggagccgtcgtccaggtccgtggggggtccctgacgtactctccgtgtacgtacgccttcgtgtaacctttcccgttacggtcttaagttggtatgacgtcgtggtccgaccnggccgcgagggaggggtctgggacggtgggtcggacccgaaagtacgtaaacgtntaaacggagtagggtaaaggtaaaggaaggtaagttactagggtcggtactcgtaggtacggtaacgggtcccgtttaacgacgtactcgtaccgaagacgtaacgaacccgacaaagacccgtcgtacgnacgttctcgataactgaaactgtcaggatcggcgaggaccagtnttaacgttntagtcgtacgatacgggagtaacgggtgtgggttaccggttacgacgttccgggtacggaccggttaacgggacccgtcggtaccg

SEQ ID NO: 281528 - DNA, 879 bp, Homo sapiens
  misc_feature: GYAE6OF02F8JVA.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggacgtcccgtggacgactctcctgtgcagtcctcgtaggactttccacccgtttcgaagttacggaccttaagttacgcctaagtggaaccgttcgggggtcccgcccgacgggccgttacccgggaaggggggtaacgggggtcgttaggggtagggtttcggggtccgtacgtaccgttacccgtaaagttttaagggtaacggtttaagggtttacgggtttaaacccttttaaaccgtaaagttttaaacgttaaacccgttaaccgggtacccgtaaacgtaaacccgtttcggaaacggggtttacggggaaccgggggggtaccccgttaaacgtttacccgaaacccgtacgttttaccctaacccgaaacgggaaccgtaaacccgaaacccggaaccccgaaaacggtaacccttacccgtaaactttacgggttaaccttaccgtaacggttaaccgtaaaacggttacggaaaccgtaaccggtacccgttagggaaacgggtaaccgggacccgggtaacggggaccgaaccgggggttcttaggggtttaacgttaacgtttacggttacggtaccgggacgggtaaccggtaccccgtacccccgttacccgtaacccgtaccgg

SEQ ID NO: 281529 - DNA, 929 bp, Homo sapiens
  misc_feature: GYAE6OF02HREOZ.37.51.E07.1.454.CMB.1.raw
  modified_base (182)..(182): a, c, t, g, unknown or other
  misc_feature (182)..(182): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttcctgttgctattttagaaggtntccagtgtgaggtgcagctggtggagtcgtgggggagccgtggtcaagccgtggggatccctgagactctcctgtgcagtccctgtaggactttccgtacccttcgaacggttagccgttaaattaacggccttaagtacggtaaaaccgttcggggggttacccccgacccgtaaacgggggtccccgttaacccggggaaggggggggtaaaaaccgggggggtccgttacgggggaaagggggtttccgggggttccttaccggtaaaccttacccggtaaaaggtttttaaagggtaaaccggtttaaggggttttaacggggttttaaaaccccttttaaggtaaaacgttttaaaacttaaaccccggtttaaacggggaccctaaaccggggttaacctttaccggtaaggggttttaccggggaaaccggggggggtacccccttaaaggtttaccccaaaccccgtaaagttttacccccgtacccggaaaacgggtaaccggtaaaaccccgaaaaccccgggaaacccgtaaaaaccgggttaaaacccttacccgtaaaccgtttacggttaaaccgttccgttaacgggtaacctaaaacgttacggtaaaaccgaccggtacccgtacggaaagggaaccggtaccgggaacgggtaaccgacgggtccgttagttacgttaacgttaccgttggacggtacggagtaccccgtaccctacccgacgttaccg

SEQ ID NO: 281530 - DNA, 711 bp, Homo sapiens
  misc_feature: GYAE6OF02FQO5E.37.51.E07.1.454.CMB.1.raw
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
  modified_base (641)..(641): a, c, t, g, unknown or other
  misc_feature (641)..(641): n is a, c, g, or t
tcagtagtgtagatcacgaccggtgctcgatttagcatactctacaacacacaaaggggctgagagaggagccttagccctggattccaaggcctatcccacttggtgatcagcactgagcacagaggactcaccatggaagttggggctgagctgggtttcctgttgctatttagaggtgtccagtgtgcgtgcaacgtggtggagtcgtgggggagtcgttggtccagccgtagggggtccctgagcctctccgtgtcncgagcctcgtggtatttacctaagtttggtacgcttagttggactgggtacgttccgggggtcccnccgtaaggttccgaccggaagggggtacggggtcgttaggggtacgggtacggggtcggacccaaacgtaacgttacggaagggggtagggttcgggttaacgggtaaaccgtaaaaacgttggtcgggttacgaacgttcgtgggtcgggtaccgggacctgtccgtacgtacgtccgtacgaagacgaaaccgaaccgaaacctaaacgtcgtacgttacgtacgtaccgtgaacgtaacgtcgggaccgtccgtacggacgtacgtccgacggtaaccgtacggtacgttcggttagttactttgttacgnggtaccgaaggttacgtaacgttacgtaacgttaacgtaacggtttacggagtacggttacgtggttaag

SEQ ID NO: 281531 - DNA, 586 bp, Homo sapiens
  misc_feature: GYAE6OF02IJ637.37.51.E07.1.454.CMB.1.raw
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (387)..(387): a, c, t, g, unknown or other
  misc_feature (387)..(387): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgacgtgcaactggtggagtcgtgggggagcgttggtccagccgtggggggtccctgagacctctcctgtgcagcctctggattcaactttggtagctattggatggactggggtccncctagtctccgaggggaagggctgggagtgggngaccaacagtacgaggggaggtgggtaggtaaacgaaaactgtggnggactcgtgtcggccggggcctattccgactagtcctccgagacgaaccaacgaacctaaaactcactgtactcgtagacgtaaagtcggacggccgtagacgtagtaccggaggacgacggtctggtagttacttgttgagcggtagagttaacttacgacttaagtaagtttcgaggttacgtacggtgtatagtag

SEQ ID NO: 281532 - DNA, 838 bp, Homo sapiens
  misc_feature: GYAE6OF02HDJI3.37.51.E07.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
tcagtagtgtagatcacgaccggtgctcgatttagcatactctacaacacacaaagggctgagagaggagccttagccctggattccaaggcctatccacttggtgatcagcactgagcaccgaggattcaccatggaacgtggggctccgcgttgggtttttccttgttgtctattttagaaggtgtccagtgtgaggtncagctggngagtcgtggggagtcctggtacaagccgtggggacgtcccgtgagacctctcctgtcgcacgtccttgtggactttccgtacccctttgaacggtcgtactaaagttacgacgtacgttacggtaaacggtccgggttacccggcccacgggtccgttaccgggaagggggtaacgggggtacgttaggggttacggttacggggttccgttaccgaacgtttaccgtaaagttttaggttaacggtttaacggtttacggtttaccttttaaacgtatttaaaccgtacgttaccgacgtaaccggtactaggtacggtcgggtaaccggggtacccggtaactttacccaacccgttaagtccccgtaccgtaacggaaacgtaacccggtaaacccggacccgtaaaacgtaacccgttaccgtaaccgtttcgttaaacccgttgtacccggtaaaccgaaaaccgttaagtaacccgtaacggtaccgtacggaaaccggggtaaccgcccggtaaacggggtaacccgtaccgggtaccgttacggttacggtttaaccttaacggttaggtaacggaccggtaaccgtacccggtacccccttacccggtaaccgtacccgg

SEQ ID NO: 281533 - DNA, 737 bp, Homo sapiens
  misc_feature: GYAE6OF02JAAI8.37.51.E07.1.454.CMB.1.raw
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagcctgggggacgtccctagacgtacctctcctggtnccagcctcgtggtacttccgaaccttcagttacnctatagcaattcgaacgttcgggccgccagggtcctccggaggggaagggtccgtagggaggttcgggtctcgaacttcctaagtttaaggtacgttagggttggttaaccttaacgtaagttaacttaaccgtaacggtaccctaaggtaacccttacggagttacgggaacggggggtcccctaagttcccaacccgtaacttacccgtaacccgaaacgggaacgaaacccgtaaaccggaaccccgaaagaaacccgttacctaaccgttacgttacctacctacggaaccctaaaagtaccggaaaccacgtaccgtacggaaagaccggtaccgggaacggaaccggtaccggtgttaaccggttagttaaccgtttaacgttccggtacggacggtaaacggacccgtacccccgcctaacccggtacg

SEQ ID NO: 281534 - DNA, 848 bp, Homo sapiens
  misc_feature: GYAE6OF02FQBHQ.37.51.E07.1.454.CMB.1.raw
  modified_base (203)..(203): a, c, t, g, unknown or other
  misc_feature (203)..(203): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgcttattttagaaggtgtccagtgtgaggtgcagntggtggagtcgtggggacggtcctggtcaacgccgtggggagtccctggagacttctcccgtggttcgcacggtccctccgttgggtactttccaacctttcgaggttaacgccttaatacgcaattagtaaaccgttcggggttacccgcccgaggcccgttacccgaagggggaaacgggggtccgttaggggacggtttacgggggttaccttaccgtaacgttacccttaagttttaacgggttaacggttaacgggtttacgggttaaaacccttttaaccgaaatttaacgtttaacccgttaacccggtaccgtaaacggtaacccgttaccggtaacggtttcggggaaccggggggttaccccgtaacgttttaccccaaaccccgtaacttacccgtacccgaaggtaaaccggaacccttaaacccggaccccgtaaaacgtaaaccctctaaccgttacggttaacttcccgtacggaacctaaaacgttaacggaaacctacggtaccctaggaaccggaaccggtacccggtaacggaaccgtacccgggtacttacggttacgttaacgttaccggttcgtacggacccgaacggtaacccgacccccgttacccgaaccccgttaccgg

SEQ ID NO: 281535 - DNA, 598 bp, Homo sapiens
  misc_feature: GYAE6OF02F42IX.37.51.E07.1.454.CMB.1.raw
  modified_base (294)..(294): a, c, t, g, unknown or other
  misc_feature (294)..(294): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcccgtggggagtcccgtgagactcctcctgttgcagcctcgtggattcaccttcagtagctanagcatgaactgggtccgccgaggctccgagggaacggggcgtgggagtcgggtctcactccagttagtagtagtgtacttacatactactacgacagactcagtggaggggccgtatacaccatctaccagaacgaaccaacgaccaaacgaaccgtactactagttataccgtacgaacgtaaagtacgtaacgacgtccgtacggaaggaccgacggacggaaccgtaccggtcgtacggtagttaacgttacgtacggtcggaccggtaacgaccgtacccccgtaccctacccgtaccgg

SEQ ID NO: 281536 - DNA, 597 bp, Homo sapiens
  misc_feature: GYAE6OF02F1ZT8.37.51.E07.1.454.CMB.1.raw
  modified_base (312)..(312): a, c, t, g, unknown or other
  misc_feature (312)..(312): n is a, c, g, or t
  modified_base (456)..(456): a, c, t, g, unknown or other
  misc_feature (456)..(456): n is a, c, g, or t
  modified_base (571)..(571): a, c, t, g, unknown or other
  misc_feature (571)..(571): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgctgggttttccttggttgctattttagaaggtgtccagtgtgaggtgcagctgggtggagtcgtgggggaggcctgggtcaaggccgtgggggggtccctggagactctccgtgtgtagcctctgaacttccccttaggcttattggatgagctgggtccnccaggctccgagggaaggggctgggagtgggtggccaaacagtaaagcaagagtagggaagtaagaggtagtagtgtggactcgtggtgaagggtccgtttcacctatcctacaggagacaacgcaaagaacctccggtgactntcctgacaaagtcgaaactgtcagacggacgaccgggaagaccgacggtacttagttttacttacgtgacgcggaaggtaggaacggacgttggggcggtttacgacgttacggnggggaccctacggggtacccttcggg

SEQ ID NO: 281537 - DNA, 621 bp, Homo sapiens
  misc_feature: GYAE6OF02JH7RI.37.51.E07.1.454.CMB.1.raw
  modified_base (256)..(256): a, c, t, g, unknown or other
  misc_feature (256)..(256): n is a, c, g, or t
  modified_base (317)..(317): a, c, t, g, unknown or other
  misc_feature (317)..(317): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggactgggctccgctggttttcctgttgcttagtttagaggtgtccagttgtgaggtgcagtcctggtggagtcgtgggggagctggtccagccgtggggactccctgacgactcgtccngtcgcacgcctctggtacttctcccttgtagtcgactactagcagtcgacgtcggtccgcnggctcgacgggaagggctcgggtaggtcggtctcactaccgacttaggtacgttaggtcggtagttacacttacgttattaccggctaacgcgttacgtacggtcgacggggtccgtaacgttccgaacctctcctacggactacggacctaacgaccgtaacgaaccgtacacgtactctacgtacgtctaaactcggaactacggacttcggaacgccgacggacgtaccgaccgggttctaggttataccgttacgtagttccggacggacgtacccgacccccttacgtacccaacccgg

SEQ ID NO: 281538 - DNA, 796 bp, Homo sapiens
  misc_feature: GYAE6OF02GH65F.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgcttattttaggaaggtgtccagtgtgaggtgcagctggtggagtcgtgggggacgccgtggtacaaggccgtaggggactcccgtgagtacctcgtccgtgtgcacggcctgtggtacttccacctttcgaaggtacgtacttataggcctaagtcggaacgttccgggggtcccgaccgtacgggtccttacccggaaagggggggtaacgggggtcccgtttagggggaaggggtttccggggttacctaccgtaacgttacccgtaagttttaacggtaggtttacgggtttacggtttaaacctttaacgaatttaacggtaaccttaaccggacgtaacggtaaccttcgtaagggtacggggtaccgggggtacccgtaagttttaccccgaacccttaacgttcccgtaacccgaaggaccgtaaaccgaaccggtaccgaaaacgtaaccgtcctaacgtacgttacttcgaacggtaacctaaagttaccgaactacgtacccgtaggaacggtacgaccggacggaccggtaccgggtcgttacgttaacgtacgttttacggtcggtaacgggccggtaacggtaccccggacccctttaccccgaccttaaccgg

SEQ ID NO: 281539 - DNA, 731 bp, Homo sapiens
  misc_feature: GYAE6OF02HP6YV.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctccgcttgggttttccttgttgtcttattttagaaggtgtccagtgtggaggtgcagcgtggtggagtcggtgggggaggccgttggtcgaacggtccgtgggggacgttcccgtgacgtacctcctccgtgtcgcacgtcctccgtggtacttcccacctttacgagtacgtactacgtacggactaagttcggtaaaccggtcggggtacccggtccgaccgggtcccgtacccgggaaagggggtaaacggggggcgtaggggtacgggttcggggtctacgtactaccgtaagttaagttacgggtagtttacggttaactaactagtaacttacgtacgactaacgtctacggtacggtacgggacggggtaccgtacttaccgaaccgtaactccgtacccgaggaacgaaacgaaccggaccaaacggtaacctactaaccgtacgttactacgtacgaactaacgtagaacgtacgaccgtaggaacgtacggaccggtacgaaccgacggtacgtcgttagtacgtttacggacggttagacccgggagtcccgtaccccttaccgtacctaccg

SEQ ID NO: 281540 - DNA, 854 bp, Homo sapiens
  misc_feature: GYAE6OF02G6TXG.37.51.E07.1.454.CMB.1.raw
tcagtagtgtagatcacgaccggtgctcgatttagcatactctacaacacacaaaggggctgagagaggagccttagccctggattccaaggcctatccacttggtgatcagcactgagcaccgaggattcaccatggacgtgggctccgcgttgggttttcctgttgcttatttaggaggtgtccagtgtgaggtgcagtcgtggtggagtcggtgggggacgtccgtggtacaacggccggtggggactccgtgacgtacctcgtccgtgtcgcgacgtccgttcgtcggtaatttccgaccctttacgaggttacgaccttagtacgacctagttacgtaaccggtccgggtacccgaccgtacggtaccgttaccgggaacgggggtaaccgggggtgttacgggggtaacggggtttcggggttacccttaccgtaaccggtttacccgttaaaggttttaacgggttaacggggtttaagggtttaccggtttaaacctttaaacggtaacgtttaaccgtaacccggttaacggacgttaaacggtacccgtttacggaagggttcggggaaccggggtcccgttaacgttacccacgttaccttacccgtaaccggaacgaacccgaaaccgtaaacccggtaacccgtaaagtacccgttacctaacgttcgtaaaccgttcccgttaaaggaaccctaaacggttaccaaacggttacgtacccggaggtaaccggaccggtaccgggtaacgggtaccgaccgggttcgtttaaggttcttaaacggttcgttaacggcggtaaccggaccgttacccggtacccccgtacgtaccctaccgg

SEQ ID NO: 281541 - DNA, 847 bp, Homo sapiens
  misc_feature: GYAE6OF02GYR0S.37.51.E07.1.454.CMB.1.raw
  modified_base (151)..(151): a, c, t, g, unknown or other
  misc_feature (151)..(151): n is a, c, g, or t
  modified_base (178)..(178): a, c, t, g, unknown or other
  misc_feature (178)..(178): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
tcagtagtgtagatcacgaccggtgctcgatttagcatactctacaacacacaaaggggctgagagaggagccttagccctggattccaaggcctatccacttggtgatcagcactgagcaccgaggattcaccatggaactggggctcgntgggtttcttgttgctatttagaggtntcgagtgngagtgcagcgtggnggagtcggtgggggagtcctggtcaacgcggtaggggacgtccgtagacgtactctaccgtgtcgcgcgcctgtacggtacttcccgtaccttcgaacggttagtccgttaagtaagaccgtaaaggttacggttaaacggtccggggtaccccgtacccggtacgggtccgttaacccggggaacggggggtaaacggggtcggttagggggtacggggttcgggttaactaccggtaactacccgttaagtttaacgggttacgttaaggggtttccgttaaactacgttactaacgttacgtaccgagtaaccgtaccgtgtaaggtacgggtacggggtacccgttaagttacccgtacctacggtaccgtacccgaaacggtaccggaaacctaaccggtaaacctaaaccgtaaccttaacgtaccgttacgttaaccgtctttaaaccggaagttaaaccaagggtaacctaccggttaacgtaaccggtaacgggtaacccgggtaaccggtaccgggaacccggtaggggttccgtttacggtttacgggtttaaacgtttacggttacccgggttacgggtaccggtaaacccgggttaaccccggtaccccccgttaccgttacccggtaacccgg

SEQ ID NO: 281542 - DNA, 152 bp, Homo sapiens
  misc_feature: GYAE6OF01AN35Z.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggcaagggaccaaggtggagatcaacgaactgtggctgcaccatctgtcttcatcttccgccatctgaatagcgtactctgagcgggctggcaaggcgcatagn

SEQ ID NO: 281543 - DNA, 148 bp, Homo sapiens
  misc_feature: GYAE6OF01C6ONZ.1.24.C02.1.454.CMB.1.raw
  modified_base (147)..(148): a, c, t, g, unknown or other
  misc_feature (147)..(148): n is a, c, g, or t
tcagacgagtgcgtcacgaccggtgctcgattagtacagatcgttaggcaaggaccaaggtggagatcaacgactgtggctgcaccatctgtcttcatcttccgccatctgaatagcgtactctgagcggctggcaaggcgcatagnn

SEQ ID NO: 281544 - DNA, 155 bp, Homo sapiens
  misc_feature: GYAE6OF01CT7JE.1.24.C02.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaaggcgcatagn

SEQ ID NO: 281545 - DNA, 151 bp, Homo sapiens
  misc_feature: GYAE6OF01BN8ZK.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggaagtgaccaaggtggagatcaactaactgtggctgcaccatctgtcttcatcttcccgccattgatcgtactgcgctgagcgggctggcaaggcgcatagn

SEQ ID NO: 281546 - DNA, 149 bp, Homo sapiens
  misc_feature: GYAE6OF01DXU28.1.24.C02.1.454.CMB.1.raw
  modified_base (149)..(149): a, c, t, g, unknown or other
  misc_feature (149)..(149): n is a, c, g, or t
tcagacgagtgcgtcacgaccggtgctcgatttagtacagatcgttaggcaaggaccaaggtggagatcaacgaactgtggctgcaccatctgtcttcatcttccgccatctgaatagcgtactctgagcggctggcaaggcgcatagn

SEQ ID NO: 281547 - DNA, 144 bp, Homo sapiens
  misc_feature: GYAE6OF01DKJCJ.1.24.C02.1.454.CMB.1.raw
  modified_base (84)..(84): a, c, t, g, unknown or other
  misc_feature (84)..(84): n is a, c, g, or t
  modified_base (98)..(98): a, c, t, g, unknown or other
  misc_feature (98)..(98): n is a, c, g, or t
tcagacgagtgcgtcacgaccggtgctcgatttagtacagatcgttaggaaggaccaaggtggagatcaacgaactgtggctgnaccatctgcttcanttccgccatctgactcgcgatatctgacgggctggcaagcgcatag

SEQ ID NO: 281548 - DNA, 160 bp, Homo sapiens
  misc_feature: GYAE6OF01AFQD4.1.24.C02.1.454.CMB.1.raw
  modified_base (152)..(160): a, c, t, g, unknown or other
  misc_feature (152)..(160): n is a, c, g, or t
tcagacgagtgcgtcacgaccggtgctcgatttagtacagatcgttagggcaagggaccaaggtggagatcaacgaactgtggctgcaccatctgtcttcatcttccgccatctgaatagcgtactctgagcgggctggcaaggcgcatagnnnnnnnnn

SEQ ID NO: 281549 - DNA, 151 bp, Homo sapiens
  misc_feature: GYAE6OF01BLLAG.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggaaggaccaaggtggagatcaaacgaactgtggctgcaccatctgtcttcatcttccgccatctgatatacgatcgctgagcgggctggcaaggcgcatagn

SEQ ID NO: 281550 - DNA, 150 bp, Homo sapiens
  misc_feature: GYAE6OF01C6RT8.1.24.C02.1.454.CMB.1.raw
  modified_base (150)..(150): a, c, t, g, unknown or other
  misc_feature (150)..(150): n is a, c, g, or t
tcagacgagtgcgtcacgaccggtgctcgatttagtacagatcgttaggcaagggaccaaggtggagatcaacgaactgtggctgcaccatctgtcttcatcttccgccatctgaatagcgtactctgagcggctggcaaggcgcatagn

SEQ ID NO: 281551 - DNA, 151 bp, Homo sapiens
  misc_feature: GYAE6OF01C6BUX.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggaaggaccaaggtggagatcaaacgaactgtggctgcaccatctgtcttcatcttcccgccatctgactcgcgtatctgagcgggctggcaaggcgcatagn

SEQ ID NO: 281552 - DNA, 154 bp, Homo sapiens
  misc_feature: GYAE6OF01CA7M7.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagn

SEQ ID NO: 281553 - DNA, 154 bp, Homo sapiens; identical to SEQ ID NO: 281552
  misc_feature: GYAE6OF01AZOTU.1.24.C02.1.454.CMB.1.raw
  modified_base (154)..(154): a, c, t, g, unknown or other
  misc_feature (154)..(154): n is a, c, g, or t

SEQ ID NO: 281554 - DNA, 148 bp, Homo sapiens
  misc_feature: GYAE6OF01B200Y.1.24.C02.1.454.CMB.1.raw
  modified_base (148)..(148): a, c, t, g, unknown or other
  misc_feature (148)..(148): n is a, c, g, or t
tcagacgagtgcgtcacgaccggtgctcgattagtacagatcgttaggcaaggaccaaggtggagatcaacgaactgtggctgcaccatctgtcttcatcttccgccatctgaatagcgtactctgagcggctggcaaggcgcatagn

SEQ ID NO: 281555 - DNA, 155 bp, Homo sapiens
  misc_feature: GYAE6OF01CCTK6.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnn

SEQ ID NO: 281556 - DNA, 149 bp, Homo sapiens
  misc_feature: GYAE6OF01BWCY7.1.24.C02.1.454.CMB.1.raw
  modified_base (149)..(149): a, c, t, g, unknown or other
  misc_feature (149)..(149): n is a, c, g, or t
tcagacgagtgcgtcacgaccggtgctcgattagtacagatcgttaggcaaggaccaaggtggagatcaacgaactgtggctgcaccatctgtcttcatcttccgccatctgatatgtatactctgagcgggctggcaaggcgcatagn

SEQ ID NO: 281557 - DNA, 152 bp, Homo sapiens
  misc_feature: GYAE6OF01B3YZL.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaaggaccaaggtggagatcaaacgaactgttgctgcaccatctgtcttcatcttcccgccatctgatcgtagcactctgagcgggctggcaaggcgcatagn

SEQ ID NO: 281558 - DNA, 151 bp, Homo sapiens
  misc_feature: GYAE6OF01EI62Y.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggaagtgaccaaggtggagatcaactaactgtggctgcaccatctgtcttcatcttccgccatctgatcgtactgcgctgagcgggctggcaaggcgcatagn

SEQ ID NO: 281559 - DNA, 163 bp, Homo sapiens
  misc_feature: GYAE6OF01D00A7.1.24.C02.1.454.CMB.1.raw
  modified_base (154)..(163): a, c, t, g, unknown or other
  misc_feature (154)..(163): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnn

SEQ ID NO: 281560 - DNA, 151 bp, Homo sapiens
  misc_feature: GYAE6OF01CBV5M.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagtgcaagggaccaaggtggagatcaacgaactgtggctgcaccatctgtcttcatcttccgccatctgactcgtctctactgagcggctggcaaggcgcatagn

SEQ ID NO: 281561 - DNA, 154 bp, Homo sapiens; identical to SEQ ID NO: 281552
  misc_feature: GYAE6OF01ET77C.1.24.C02.1.454.CMB.1.raw
  modified_base (154)..(154): a, c, t, g, unknown or other
  misc_feature (154)..(154): n is a, c, g, or t

SEQ ID NO: 281562 - DNA, 160 bp, Homo sapiens
  misc_feature: GYAE6OF01AIIS0.1.24.C02.1.454.CMB.1.raw
  modified_base (153)..(160): a, c, t, g, unknown or other
  misc_feature (153)..(160): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaatagcgtactctgagcgggctggcaaggcgcatagnnnnnnnn

SEQ ID NO: 281563 - DNA, 157 bp, Homo sapiens
  misc_feature: GYAE6OF01DYY3R.1.24.C02.1.454.CMB.1.raw
  modified_base (152)..(157): a, c, t, g, unknown or other
  misc_feature (152)..(157): n is a, c, g, or t
tcagacgagtgcgtcacgaccggtgctcgatttagtacagatcgttagggcaagggaccaaggtggagatcaaacgaactgtggctgcaccatctgtcttcatcttccgccatctgatatgtatactctgagcggctggcaaggcgcatagnnnnnn

SEQ ID NO: 281564 - DNA, 187 bp, Homo sapiens
  misc_feature: GYAE6OF01DGJ8N.1.24.C02.1.454.CMB.1.raw
  modified_base (122)..(122): a, c, t, g, unknown or other
  misc_feature (122)..(122): n is a, c, g, or t
  modified_base (136)..(136): a, c, t, g, unknown or other
  misc_feature (136)..(136): n is a, c, g, or t
  modified_base (157)..(187): a, c, t, g, unknown or other
  misc_feature (157)..(187): n is a, c, g, or t
tcagacgagtgcgtcacgaccggtgctcgatttagtacagatcgttagggaaagggaccgaaggtggagatcaaacgaactgtggctgcaccaatctgtcttcatcttcccgccatctgatntaccgatcgctgancgggctggcaaggcgcatagnnnnnnnnnnnnnnnnnnnnnnnnnnnnnnn

SEQ ID NO: 281565 - DNA, 150 bp, Homo sapiens
  misc_feature: GYAE6OF01DZ1WI.1.24.C02.1.454.CMB.1.raw
  modified_base (150)..(150): a, c, t, g, unknown or other
  misc_feature (150)..(150): n is a, c, g, or t
tcagacgagtgcgtcacgaccggtgctcgatttagtacagatcgttaggaagtgaccaaggtggagatcaactaactgtggctgcaccatctgtcttcatcttccgccatctgatcgtactgcgctgagcgggctggcaaggcgcatagn

SEQ ID NO: 281566 - DNA, 156 bp, Homo sapiens
  misc_feature: GYAE6OF01BQAXD.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatagnnn

SEQ ID NO: 281567 - DNA, 161 bp, Homo sapiens
  misc_feature: GYAE6OF01AVUFS.1.24.C02.1.454.CMB.1.raw
  modified_base (153)..(161): a, c, t, g, unknown or other
  misc_feature (153)..(161): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgatcgtagcactctgagcgggctggcaaggcgcatagnnnnnnnnn

SEQ ID NO: 281568 - DNA, 153 bp, Homo sapiens
  misc_feature: GYAE6OF01CX5UX.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaacgaactgtggctgcaccatctgtcttcatcttcccgccatctgatatgtatactctgagcgggctggcaaggcgcatagn

SEQ ID NO: 281569 - DNA, 154 bp, Homo sapiens
  misc_feature: GYAE6OF01ED3MJ.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagn

SEQ ID NO: 281570 - DNA, 178 bp, Homo sapiens
  misc_feature: GYAE6OF01CCQVD.1.24.C02.1.454.CMB.1.raw
  modified_base (153)..(178): a, c, t, g, unknown or other
  misc_feature (153)..(178): n is a, c, g, or t
tcagacgagtgcgtcacgaccggtgctcgatttagtacagatcgttagggcaagggaccaaggtggagatcaacgaactgtggctgcaccatcgtgtcttcatcttaccgcatctgatatgtatactctgagcgggctggcaaggcgcatagnnnnnnnnnnnnnnnnnnnnnnnnnn

SEQ ID NO: 281571 - DNA, 167 bp, Homo sapiens
  misc_feature: GYAE6OF01EEEO5.1.24.C02.1.454.CMB.1.raw
  modified_base (154)..(167): a, c, t, g, unknown or other
  misc_feature (154)..(167): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtagcgtgctgagcgggctggcaaggcgcatagnnnnnnnnnnnnnn

SEQ ID NO: 281572 - DNA, 154 bp, Homo sapiens
  misc_feature: GYAE6OF01A833F.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagn

SEQ ID NO: 281573 - DNA, 155 bp, Homo sapiens; identical to SEQ ID NO: 281555
  misc_feature: GYAE6OF01ETK97.1.24.C02.1.454.CMB.1.raw
  modified_base (154)..(155): a, c, t, g, unknown or other
  misc_feature (154)..(155): n is a, c, g, or t

SEQ ID NO: 281574 - DNA, 151 bp, Homo sapiens
  misc_feature: GYAE6OF01C35X1.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggaagggaccaaggtggagatcaacgaactgtggctgcaccatctgtcttcatcttccgccatctgaatagcgtactctgagcgggctggcaaggcgcatagn

SEQ ID NO: 281575 - DNA, 155 bp, Homo sapiens
  misc_feature: GYAE6OF01BFASH.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnn

SEQ ID NO: 281576 - DNA, 154 bp, Homo sapiens
  misc_feature: GYAE6OF01BM2Q6.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagn

SEQ ID NO: 281577 - DNA, 153 bp, Homo sapiens
  misc_feature: GYAE6OF01DFS2V.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagtgaccaaggtggagatcaaactaactgtggctgcaccatctgtcttcatcttcccgccatctgatcgtactgcgctgagcgggctggcaaggcgcatagn

SEQ ID NO: 281578 - DNA, 155 bp, Homo sapiens; identical to SEQ ID NO: 281555
  misc_feature: GYAE6OF01DXECF.1.24.C02.1.454.CMB.1.raw
  modified_base (154)..(155): a, c, t, g, unknown or other
  misc_feature (154)..(155): n is a, c, g, or t

SEQ ID NO: 281579 - DNA, 154 bp, Homo sapiens; identical to SEQ ID NO: 281552
  misc_feature: GYAE6OF01DHSDJ.1.24.C02.1.454.CMB.1.raw
  modified_base (154)..(154): a, c, t, g, unknown or other
  misc_feature (154)..(154): n is a, c, g, or t

SEQ ID NO: 281580 - DNA, 153 bp, Homo sapiens
  misc_feature: GYAE6OF01EAYBA.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaacgaactgtggctgcaccatctgtcttcatcttcccgccatctgaatagcgtactctgagcgggctggcaaggcgcatagn

SEQ ID NO: 281581 - DNA, 160 bp, Homo sapiens
  misc_feature: GYAE6OF01AT29E.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgatatgtatactctgagcgggctggcaaggcgcatagnnnnnnn

SEQ ID NO: 281582 - DNA, 153 bp, Homo sapiens
  misc_feature: GYAE6OF01EBW49.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaacgaactgtggctgaaccatctgtcttcatcttcccgccatctgaatagcgtactctgagcgggctggcaaggcgcatagn

SEQ ID NO: 281583 - DNA, 154 bp, Homo sapiens; identical to SEQ ID NO: 281552
  misc_feature: GYAE6OF01DV0KD.1.24.C02.1.454.CMB.1.raw
  modified_base (154)..(154): a, c, t, g, unknown or other
  misc_feature (154)..(154): n is a, c, g, or t

SEQ ID NO: 281584 - DNA, 154 bp, Homo sapiens
  misc_feature: GYAE6OF01BCXZ4.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaactaactgtggctgcacaatctgtcttcatcttcccgccatctgatcgtactgcgctgagcgggctggcaaggcgcatagn

SEQ ID NO: 281585 - DNA, 154 bp, Homo sapiens; identical to SEQ ID NO: 281569
  misc_feature: GYAE6OF01EA2WW.1.24.C02.1.454.CMB.1.raw
  modified_base (154)..(154): a, c, t, g, unknown or other
  misc_feature (154)..(154): n is a, c, g, or t

SEQ ID NO: 281586 - DNA, 159 bp, Homo sapiens
  misc_feature: GYAE6OF01B8WA2.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctctcgtactgcgctgagcgggctggcaaggcgcatagnnnnnn

SEQ ID NO: 281587 - DNA, 183 bp, Homo sapiens
  misc_feature: GYAE6OF01EDK5R.1.24.C02.1.454.CMB.1.raw
  modified_base (155)..(183): a, c, t, g, unknown or other
  misc_feature (155)..(183): n is a, c, g, or t
tcagacgagtgcgtcacgaccggtgctcgatttagtacagatcgttagggcaagggaccgaaggtggagatcaaacgaactgtggctgcaccatctgtcttcatcttccgccatcctgaatagcgtactctgagcgggctggcaaggcgcatagnnnnnnnnnnnnnnnnnnnnnnnnnnnnn

SEQ ID NO: 281588 - DNA, 153 bp, Homo sapiens
  misc_feature: GYAE6OF01DJVX9.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccctcctcacgtctactgctgagcgggctggcaaggcgcatagn

SEQ ID NO: 281589 - DNA, 154 bp, Homo sapiens; identical to SEQ ID NO: 281552
  misc_feature: GYAE6OF01BFPSB.1.24.C02.1.454.CMB.1.raw
  modified_base (154)..(154): a, c, t, g, unknown or other
  misc_feature (154)..(154): n is a, c, g, or t

SEQ ID NO: 281590 - DNA, 198 bp, Homo sapiens
  misc_feature: GYAE6OF01C26H5.1.24.C02.1.454.CMB.1.raw
  modified_base (153)..(198): a, c, t, g, unknown or other
  misc_feature (153)..(198): n is a, c, g, or t
tcagacgagtgcgtcacgaccggtgctcgatttagtacagatcgttagggcgaagggaaccaaggtggagatcaaacgaacctgtggctgaaccatctgtcttcatcttccgcatctgaatagcgtatctgagcggctggcaaggcgcatagnnnnnnnnnnnnnnnnnnnnnnnnnnnnnnnnnnnnnnnnnnnnnn

SEQ ID NO: 281591 - DNA, 155 bp, Homo sapiens
  misc_feature: GYAE6OF01CJFO7.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgatatgtatactctgagcgggctggcaaggcgcatagnn

SEQ ID NO: 281592 - DNA, 153 bp, Homo sapiens
  misc_feature: GYAE6OF01BEHIY.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaaaggaccaaggtggagatcaaacgaactgtggctgcaccatctgtcttcatcttcccgccatctgatatacgatcgctgagcggctggcaaggcgcatagnn

SEQ ID NO: 281593 - DNA, 152 bp, Homo sapiens
  misc_feature: GYAE6OF01EDQZV.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttaggcaagggaccaaggtggagatcaacgaactgtggctgcaccatctgtcttcatcttcccgccatctgatatgtatactctgagcgggctggcaaggcgcatagn

SEQ ID NO: 281594 - DNA, 153 bp, Homo sapiens
  misc_feature: GYAE6OF01B7E1M.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgattgtatactctgagcgggctggcaaggcgcatagn

SEQ ID NO: 281595 - DNA, 156 bp, Homo sapiens
  misc_feature: GYAE6OF01B735D.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnn

SEQ ID NO: 281596 - DNA, 153 bp, Homo sapiens
  misc_feature: GYAE6OF01DC57H.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttccgccatctgaatagcgtactctgagcgggctggcaaggcgcatagn

SEQ ID NO: 281597 - DNA, 157 bp, Homo sapiens
  misc_feature: GYAE6OF01BRRDI.1.24.C02.1.454.CMB.1.raw
  modified_base (153)..(157): a, c, t, g, unknown or other
  misc_feature (153)..(157): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnnnnn

SEQ ID NO: 281598 - DNA, 154 bp, Homo sapiens
  misc_feature: GYAE6OF01A545O.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgcatagn

SEQ ID NO: 281599 - DNA, 157 bp, Homo sapiens
  misc_feature: GYAE6OF01ENQ5J.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnn

SEQ ID NO: 281600 - DNA, 161 bp, Homo sapiens
  misc_feature: GYAE6OF01EBZY1.1.24.C02.1.454.CMB.1.raw
  modified_base (154)..(161): a, c, t, g, unknown or other
  misc_feature (154)..(161): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnn

SEQ ID NO: 281601 - DNA, 154 bp, Homo sapiens; identical to SEQ ID NO: 281552
  misc_feature: GYAE6OF01BUGE6.1.24.C02.1.454.CMB.1.raw
  modified_base (154)..(154): a, c, t, g, unknown or other
  misc_feature (154)..(154): n is a, c, g, or t

SEQ ID NO: 281602 - DNA, 152 bp, Homo sapiens
  misc_feature: GYAE6OF01C8CWT.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgactcgcgatatctgagcggctggcaaggcgcatagn

SEQ ID NO: 281603 - DNA, 156 bp, Homo sapiens
  misc_feature: GYAE6OF01CTM3I.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggcaagggaccaaggtggagatcaacgaactgtggctgcaccatctgtcttcatcttcccgccatctgaatagcgtactctgagcgggctggcaaggcgcatagnnnn

SEQ ID NO: 281604 - DNA, 154 bp, Homo sapiens
  misc_feature: GYAE6OF01ADETJ.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagn

SEQ ID NO: 281605 - DNA, 154 bp, Homo sapiens; identical to SEQ ID NO: 281572
  misc_feature: GYAE6OF01A36SO.1.24.C02.1.454.CMB.1.raw
  modified_base (154)..(154): a, c, t, g, unknown or other
  misc_feature (154)..(154): n is a, c, g, or t

SEQ ID NO: 281606 - DNA, 155 bp, Homo sapiens; identical to SEQ ID NO: 281555
  misc_feature: GYAE6OF01EHVJ8.1.24.C02.1.454.CMB.1.raw
  modified_base (154)..(155): a, c, t, g, unknown or other
  misc_feature (154)..(155): n is a, c, g, or t

SEQ ID NO: 281607 - DNA, 154 bp, Homo sapiens
  misc_feature: GYAE6OF01DYMXC.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagn

SEQ ID NO: 281608 - DNA, 178 bp, Homo sapiens
  misc_feature: GYAE6OF01DEZSX.1.24.C02.1.454.CMB.1.raw
  modified_base (157)..(178): a, c, t, g, unknown or other
  misc_feature (157)..(178): n is a, c, g, or t
tcagacgagtgcgtcacgaccggtgctcgatttagtacagatcgttagggaaagggtaccgaaggtggagatcaaacgaactgtggctgcaccatctgtacttcatcttcccgccatctgactcgcgatatctgagcgggctggcaaggcgcatagnnnnnnnnnnnnnnnnnnnnnn

SEQ ID NO: 281609 - DNA, 154 bp, Homo sapiens
  misc_feature: GYAE6OF01C09GQ.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatagn

SEQ ID NO: 281610 - DNA, 156 bp, Homo sapiens
  misc_feature: GYAE6OF01EB862.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgtatactctgagcgggctggcaaggcgcatagnnn

SEQ ID NO: 281611 - DNA, 167 bp, Homo sapiens
  misc_feature: GYAE6OF01D6HP5.1.24.C02.1.454.CMB.1.raw
  modified_base (155)..(167): a, c, t, g, unknown or other
  misc_feature (155)..(167): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgtcatagnnnnnnnnnnnnn

SEQ ID NO: 281612 - DNA, 155 bp, Homo sapiens; identical to SEQ ID NO: 281575
  misc_feature: GYAE6OF01CVVQV.1.24.C02.1.454.CMB.1.raw
  modified_base (154)..(155): a, c, t, g, unknown or other
  misc_feature (154)..(155): n is a, c, g, or t

SEQ ID NO: 281613 - DNA, 153 bp, Homo sapiens
  misc_feature: GYAE6OF01A49LX.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaagggaccaaggtggagatcaacgaactgtggctgcaccatctgtcttcatcttcccgccatctgaacgcactcgtctgagcgggctggcaaggcgcatagnn

SEQ ID NO: 281614 - DNA, 154 bp, Homo sapiens
  misc_feature: GYAE6OF01CE0BI.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgtatactctgagcgggctggcaaggcgcatagn

SEQ ID NO: 281615 - DNA, 154 bp, Homo sapiens; identical to SEQ ID NO: 281604
  misc_feature: GYAE6OF01CDU9B.1.24.C02.1.454.CMB.1.raw
  modified_base (154)..(154): a, c, t, g, unknown or other
  misc_feature (154)..(154): n is a, c, g, or t

SEQ ID NO: 281616 - DNA, 154 bp, Homo sapiens
  misc_feature: GYAE6OF01EX7UH.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgcaccatctgtctttatcttcccgccatctgaatagcgtactctgagcgggctggcaaggcgcatagn

SEQ ID NO: 281617 - DNA, 154 bp, Homo sapiens; identical to SEQ ID NO: 281604
  misc_feature: GYAE6OF01BGN5D.1.24.C02.1.454.CMB.1.raw
  modified_base (154)..(154): a, c, t, g, unknown or other
  misc_feature (154)..(154): n is a, c, g, or t

SEQ ID NO: 281618 - DNA, 153 bp, Homo sapiens
  misc_feature: GYAE6OF01B58O3.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgatatgtatactctgagcgggctggcaaggcgcatagn

SEQ ID NO: 281619 - DNA, 154 bp, Homo sapiens
  misc_feature: GYAE6OF01C0JPL.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaatagcgtactctgagcgggctggcaaggcgcatagnn

SEQ ID NO: 281620 - DNA, 155 bp, Homo sapiens; identical to SEQ ID NO: 281555
  misc_feature: GYAE6OF01C5K0H.1.24.C02.1.454.CMB.1.raw
  modified_base (154)..(155): a, c, t, g, unknown or other
  misc_feature (154)..(155): n is a, c, g, or t

SEQ ID NO: 281621 - DNA, 153 bp, Homo sapiens
  misc_feature: GYAE6OF01AS428.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgatctctcgactctgagcgggctggcaaggcgcatagn

SEQ ID NO: 281622 - DNA, 173 bp, Homo sapiens
  misc_feature: GYAE6OF01DWVF1.1.24.C02.1.454.CMB.1.raw
  modified_base (154)..(173): a, c, t, g, unknown or other
  misc_feature (154)..(173): n is a, c, g, or t
tcagacgagtgcgtcacgaccggtgctcgatttagtacagatcgttaggcaagggaccaaggtggagatcaaacgaactgtggctgcaccatctgtcttcatcttacccgccatctgaatagcgtactctgagcgggctggcaaggcgcatagnnnnnnnnnnnnnnnnnnnn

SEQ ID NO: 281623 - DNA, 153 bp, Homo sapiens
  misc_feature: GYAE6OF01BOWRK.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaagtgaccaaggtggagatcaaacgaactgtggctgcaccatctgtcttcatcttcccgcctcctctctctcgactctgagcgggctggcaaggcgcatagnn

SEQ ID NO: 281624 - DNA, 154 bp, Homo sapiens; identical to SEQ ID NO: 281552
  misc_feature: GYAE6OF01D86FR.1.24.C02.1.454.CMB.1.raw
  modified_base (154)..(154): a, c, t, g, unknown or other
  misc_feature (154)..(154): n is a, c, g, or t

SEQ ID NO: 281625 - DNA, 153 bp, Homo sapiens; identical to SEQ ID NO: 281596
  misc_feature: GYAE6OF01EWGGG.1.24.C02.1.454.CMB.1.raw
  modified_base (153)..(153): a, c, t, g, unknown or other
  misc_feature (153)..(153): n is a, c, g, or t

SEQ ID NO: 281626 - DNA, 154 bp, Homo sapiens; identical to SEQ ID NO: 281552
  misc_feature: GYAE6OF01CG5JS.1.24.C02.1.454.CMB.1.raw
  modified_base (154)..(154): a, c, t, g, unknown or other
  misc_feature (154)..(154): n is a, c, g, or t

SEQ ID NO: 281627 - DNA, 154 bp, Homo sapiens; identical to SEQ ID NO: 281552
  misc_feature: GYAE6OF01AKLD7.1.24.C02.1.454.CMB.1.raw
  modified_base (154)..(154): a, c, t, g, unknown or other
  misc_feature (154)..(154): n is a, c, g, or t

SEQ ID NO: 281628 - DNA, 162 bp, Homo sapiens
  misc_feature: GYAE6OF01BOLH7.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnn

SEQ ID NO: 281629 - DNA, 154 bp, Homo sapiens; identical to SEQ ID NO: 281552
  misc_feature: GYAE6OF01BRRUD.1.24.C02.1.454.CMB.1.raw
  modified_base (154)..(154): a, c, t, g, unknown or other
  misc_feature (154)..(154): n is a, c, g, or t

SEQ ID NO: 281630 - DNA, 164 bp, Homo sapiens
  misc_feature: GYAE6OF01CQMKD.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnn

SEQ ID NO: 281631 - DNA, 154 bp, Homo sapiens; identical to SEQ ID NO: 281552
  misc_feature: GYAE6OF01EIAEX.1.24.C02.1.454.CMB.1.raw
  modified_base (154)..(154): a, c, t, g, unknown or other
  misc_feature (154)..(154): n is a, c, g, or t

SEQ ID NO: 281632 - DNA, 167 bp, Homo sapiens
  misc_feature: GYAE6OF01DAEB4.1.24.C02.1.454.CMB.1.raw
  modified_base (154)..(167): a, c, t, g, unknown or other
  misc_feature (154)..(167): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnnnnn

SEQ ID NO: 281633 - DNA, 155 bp, Homo sapiens
  misc_feature: GYAE6OF01CMUAU.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaacgcactcgtctgagcgggctggcaaggcgcatagnnn

SEQ ID NO: 281634 - DNA, 154 bp, Homo sapiens; identical to SEQ ID NO: 281607
  misc_feature: GYAE6OF01D6ZM7.1.24.C02.1.454.CMB.1.raw
  modified_base (154)..(154): a, c, t, g, unknown or other
  misc_feature (154)..(154): n is a, c, g, or t

SEQ ID NO: 281635 - DNA, 166 bp, Homo sapiens
  misc_feature: GYAE6OF01DFKRA.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggcaaggggaccaaggtggagatcaaacgaactgtggctgcaccatctgtcttcatcttcccgccatctgaatagcgtactctgagcgggctggcaaggcgcatagnnnnnnnnnnnn

SEQ ID NO: 281636 - DNA, 154 bp, Homo sapiens; identical to SEQ ID NO: 281614
  misc_feature: GYAE6OF01D5QES.1.24.C02.1.454.CMB.1.raw
  modified_base (154)..(154): a, c, t, g, unknown or other
  misc_feature (154)..(154): n is a, c, g, or t

SEQ ID NO: 281637 - DNA, 154 bp, Homo sapiens; identical to SEQ ID NO: 281604
  misc_feature: GYAE6OF01CS04L.1.24.C02.1.454.CMB.1.raw
  modified_base (154)..(154): a, c, t, g, unknown or other
  misc_feature (154)..(154): n is a, c, g, or t

SEQ ID NO: 281638 - DNA, 154 bp, Homo sapiens; identical to SEQ ID NO: 281552
  misc_feature: GYAE6OF01DCXQS.1.24.C02.1.454.CMB.1.raw
  modified_base (154)..(154): a, c, t, g, unknown or other
  misc_feature (154)..(154): n is a, c, g, or t

SEQ ID NO: 281639 - DNA, 162 bp, Homo sapiens
  misc_feature: GYAE6OF01CFU0B.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnnnnnnnn

SEQ ID NO: 281640 - DNA, 149 bp, Homo sapiens
  misc_feature: GYAE6OF01ACWOK.1.24.C02.1.454.CMB.1.raw
  modified_base (149)..(149): a, c, t, g, unknown or other
  misc_feature (149)..(149): n is a, c, g, or t
tcagacgagtgcgtcacgaccggtgctcgatttagtacagatcgttaggcaagggaccaaggtggagatcaaacgaactgtggctgcaccatctgtcttcatcttccgcatctgaatagcgtactctgagcggctggcaaggcgcatgn

SEQ ID NO: 281641 - DNA, 154 bp, Homo sapiens
  misc_feature: GYAE6OF01AYJUR.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagn

SEQ ID NO: 281642 - DNA, 154 bp, Homo sapiens; identical to SEQ ID NO: 281552
  misc_feature: GYAE6OF01DE6DY.1.24.C02.1.454.CMB.1.raw
  modified_base (154)..(154): a, c, t, g, unknown or other
  misc_feature (154)..(154): n is a, c, g, or t

SEQ ID NO: 281643 - DNA, 155 bp, Homo sapiens; identical to SEQ ID NO: 281555
  misc_feature: GYAE6OF01CM3FM.1.24.C02.1.454.CMB.1.raw
  modified_base (154)..(155): a, c, t, g, unknown or other
  misc_feature (154)..(155): n is a, c, g, or t

SEQ ID NO: 281644 - DNA, 154 bp, Homo sapiens
  misc_feature: GYAE6OF01C3ANY.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgatatgtatactctgagcgggctggcaaggcgcatagn

SEQ ID NO: 281645 - DNA, 154 bp, Homo sapiens; identical to SEQ ID NO: 281569
  misc_feature: GYAE6OF01COM5J.1.24.C02.1.454.CMB.1.raw
  modified_base (154)..(154): a, c, t, g, unknown or other
  misc_feature (154)..(154): n is a, c, g, or t

SEQ ID NO: 281646 - DNA, 154 bp, Homo sapiens; identical to SEQ ID NO: 281552
  misc_feature: GYAE6OF01ED9FG.1.24.C02.1.454.CMB.1.raw
  modified_base (154)..(154): a, c, t, g, unknown or other
  misc_feature (154)..(154): n is a, c, g, or t

SEQ ID NO: 281647 - DNA, 165 bp, Homo sapiens
  misc_feature: GYAE6OF01DPCL0.1.24.C02.1.454.CMB.1.raw
  modified_base (154)..(165): a, c, t, g, unknown or other
  misc_feature (154)..(165): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatagnnnnnnnnnnnn

SEQ ID NO: 281648 - DNA, 154 bp, Homo sapiens; identical to SEQ ID NO: 281604
  misc_feature: GYAE6OF01BOKU2.1.24.C02.1.454.CMB.1.raw
  modified_base (154)..(154): a, c, t, g, unknown or other
  misc_feature (154)..(154): n is a, c, g, or t

SEQ ID NO: 281649 - DNA, 154 bp, Homo sapiens; identical to SEQ ID NO: 281552
  misc_feature: GYAE6OF01AG6S0.1.24.C02.1.454.CMB.1.raw
  modified_base (154)..(154): a, c, t, g, unknown or other
  misc_feature (154)..(154): n is a, c, g, or t

SEQ ID NO: 281650 - DNA, 157 bp, Homo sapiens; identical to SEQ ID NO: 281599
  misc_feature: GYAE6OF01BOAUK.1.24.C02.1.454.CMB.1.raw
  modified_base (154)..(157): a, c, t, g, unknown or other
  misc_feature (154)..(157): n is a, c, g, or t

SEQ ID NO: 281651 - DNA, 153 bp, Homo sapiens
  misc_feature: GYAE6OF01AONNS.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaacgcactcgtctgagcgggctggcaaggcgcatagn

SEQ ID NO: 281652 - DNA, 152 bp, Homo sapiens
  misc_feature: GYAE6OF01EYJ8H.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaagggaccaaggtggaatcaaacgaactgtggctgcaccatctgtcttcatcttcccgccatctgaacgcactcgtctgagcgggctggcaaggcgcatagn

SEQ ID NO: 281653 - DNA, 153 bp, Homo sapiens
  misc_feature: GYAE6OF01APJX5.1.24.C02.1.454.CMB.1.raw
tcagacgagtgcgtcacgaccggtgctcgatttagtacagatcgttagggcaagggaccaaggtggagatcaaacgaactgtggctgcaccatctgtcttcatcttcccgccatctgatatgtatactctgagcgggctggcaaggcgcatag

SEQ ID NO: 281654 - DNA, 154 bp, Homo sapiens; identical to SEQ ID NO: 281552
  misc_feature: GYAE6OF01CNETM.1.24.C02.1.454.CMB.1.raw
  modified_base (154)..(154): a, c, t, g, unknown or other
  misc_feature (154)..(154): n is a, c, g, or t

SEQ ID NO: 281655 - DNA, 154 bp, Homo sapiens; identical to SEQ ID NO: 281604
  misc_feature: GYAE6OF01BMYFZ.1.24.C02.1.454.CMB.1.raw
  modified_base (154)..(154): a, c, t, g, unknown or other
  misc_feature (154)..(154): n is a, c, g, or t

SEQ ID NO: 281656 - DNA, 154 bp, Homo sapiens; identical to SEQ ID NO: 281552
  misc_feature: GYAE6OF01C57O0.1.24.C02.1.454.CMB.1.raw
  modified_base (154)..(154): a, c, t, g, unknown or other
  misc_feature (154)..(154): n is a, c, g, or t

SEQ ID NO: 281657 - DNA, 155 bp, Homo sapiens; identical to SEQ ID NO: 281555
  misc_feature: GYAE6OF01DDY51.1.24.C02.1.454.CMB.1.raw
  modified_base (154)..(155): a, c, t, g, unknown or other
  misc_feature (154)..(155): n is a, c, g, or t

SEQ ID NO: 281658 - DNA, 154 bp, Homo sapiens; identical to SEQ ID NO: 281607
  misc_feature: GYAE6OF01BM3FB.1.24.C02.1.454.CMB.1.raw
  modified_base (154)..(154): a, c, t, g, unknown or other
  misc_feature (154)..(154): n is a, c, g, or t

SEQ ID NO: 281659 - DNA, 156 bp, Homo sapiens
  misc_feature: GYAE6OF01BTQTR.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatcgtagcactctgagcgggctggcaaggcgcatagnnn

SEQ ID NO: 281660 - DNA, 153 bp, Homo sapiens; identical to SEQ ID NO: 281577
  misc_feature: GYAE6OF01EAX2I.1.24.C02.1.454.CMB.1.raw
  modified_base (153)..(153): a, c, t, g, unknown or other
  misc_feature (153)..(153): n is a, c, g, or t

SEQ ID NO: 281661 - DNA, 156 bp, Homo sapiens
  misc_feature: GYAE6OF01CRQ01.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnn

SEQ ID NO: 281662 - DNA, 152 bp, Homo sapiens
  misc_feature: GYAE6OF01BPJ5F.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaaggaccaaggtggaaatcaaacgaactgtggctgcaccatctgtcttcatcttcccgccatctgaacgcactcgtctgagcgggctggcaaggcgcatagn

SEQ ID NO: 281663 - DNA, 183 bp, Homo sapiens
  misc_feature: GYAE6OF01DFE10.1.24.C02.1.454.CMB.1.raw
  modified_base (157)..(183): a, c, t, g, unknown or other
  misc_feature (157)..(183): n is a, c, g, or t
tcagacgagtgcgtcacgaccggtgctcgatttagtacagatcgttagggaaagggaccaaggggtggagatcaaacgaactgtggctgcaccatctgtcttcatcttcccgcatctgaatagcgtactctgagcgggctggcaagggcgcactagnnnnnnnnnnnnnnnnnnnnnnnnnnn

SEQ ID NO: 281664 - DNA, 154 bp, Homo sapiens; identical to SEQ ID NO: 281552
  misc_feature: GYAE6OF01EW8Q8.1.24.C02.1.454.CMB.1.raw
  modified_base (154)..(154): a, c, t, g, unknown or other
  misc_feature (154)..(154): n is a, c, g, or t

SEQ ID NO: 281665 - DNA, 148 bp, Homo sapiens
  misc_feature: GYAE6OF01CFREE.1.24.C02.1.454.CMB.1.raw
  modified_base (148)..(148): a, c, t, g, unknown or other
  misc_feature (148)..(148): n is a, c, g, or t
tcagacgagtgcgtcacgaccggtgctcgatttagtacagatcgttaggaaggaccaaggtggagatcaacgaactgtggctgcaccatctgtcttcatcttcccacctcctcacgcactcgtctgagcggctggcaaggcgcatagn

SEQ ID NO: 281666 - DNA, 153 bp, Homo sapiens; identical to SEQ ID NO: 281582
  misc_feature: GYAE6OF01D83E3.1.24.C02.1.454.CMB.1.raw
  modified_base (153)..(153): a, c, t, g, unknown or other
  misc_feature (153)..(153): n is a, c, g, or t

SEQ ID NO: 281667 - DNA, 154 bp, Homo sapiens; identical to SEQ ID NO: 281641
  misc_feature: GYAE6OF01C1HA6.1.24.C02.1.454.CMB.1.raw
  modified_base (154)..(154): a, c, t, g, unknown or other
  misc_feature (154)..(154): n is a, c, g, or t

SEQ ID NO: 281668 - DNA, 155 bp, Homo sapiens
  misc_feature: GYAE6OF01CHK6L.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagtgcaagggaccaaggtggagatcaaacgaactgtggctgcaccatctgtcttcatcttcccgccatctgactcgtctctactgagcgggctggcaaggcgcatagnn

SEQ ID NO: 281669 - DNA, 194 bp, Homo sapiens
  misc_feature: GYAE6OF01EYYBV.1.24.C02.1.454.CMB.1.raw
  modified_base (155)..(194): a, c, t, g, unknown or other
  misc_feature (155)..(194): n is a, c, g, or t
tcagacgagtgcgtcacgaccggtgctcgatttagtacagatcgttagggcaagggaccaaggtggagatcaaacgaactgtggctgcaccatctgtcttcatcttacccgccatctgaatagcgtactctgagcgggctggcaaggcgcatagnnnnnnnnnnnnnnnnnnnnnnnnnnnnnnnnnnnnnnnn

SEQ ID NO: 281670 - DNA, 154 bp, Homo sapiens
  misc_feature: GYAE6OF01DFE09.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgtctactgctgagcgggctggcaaggcgcatagn

SEQ ID NO: 281671 - DNA, 154 bp, Homo sapiens
  misc_feature: GYAE6OF01BGHN2.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgcactcgtctgagcgggctggcaaggcgcatagn

SEQ ID NO: 281672 - DNA, 171 bp, Homo sapiens
  misc_feature: GYAE6OF01C31CF.1.24.C02.1.454.CMB.1.raw
  modified_base (155)..(171): a, c, t, g, unknown or other
  misc_feature (155)..(171): n is a, c, g, or t
tcagacgagtgcgtcacgaccggtgctcgatttagtacagatcgttagggaagtgaccaaggtggagatcaaactaactgtggctagcaccatctgtcttcatcttcccgccatctgatcgtactgcgctgagcgggctggcaaggcgcatagcnnnnnnnnnnnnnnnnn

SEQ ID NO: 281673 - DNA, 153 bp, Homo sapiens
  misc_feature: GYAE6OF01C10VW.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgatatacgatcgctgagcgggctggcaaggcgcatagn

SEQ ID NO: 281674 - DNA, 154 bp, Homo sapiens; identical to SEQ ID NO: 281607
  misc_feature: GYAE6OF01BXXP8.1.24.C02.1.454.CMB.1.raw
  modified_base (154)..(154): a, c, t, g, unknown or other
  misc_feature (154)..(154): n is a, c, g, or t

SEQ ID NO: 281675 - DNA, 155 bp, Homo sapiens
  misc_feature: GYAE6OF01B2KHK.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnn

SEQ ID NO: 281676 - DNA, 156 bp, Homo sapiens; identical to SEQ ID NO: 281661
  misc_feature: GYAE6OF01DOFZ9.1.24.C02.1.454.CMB.1.raw
  modified_base (154)..(156): a, c, t, g, unknown or other
  misc_feature (154)..(156): n is a, c, g, or t

SEQ ID NO: 281677 - DNA, 154 bp, Homo sapiens
  misc_feature: GYAE6OF01CFTQ5.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaacgcactcgtctgagcgggctggcaaggcgcatagnn

SEQ ID NO: 281678 - DNA, 194 bp, Homo sapiens
  misc_feature: GYAE6OF01AGE88.1.24.C02.1.454.CMB.1.raw
  modified_base (156)..(194): a, c, t, g, unknown or other
  misc_feature (156)..(194): n is a, c, g, or t
tcagacgagtgcgtcacgaccggtgctcgatttagtacagatcgttagggaagtgaccaaggtggagatcgaaactaactgtggctgcaccatctgtcttcatcttcccgcatctgatcgtactgcgctgagccgggctggctaaggcgcataggnnnnnnnnnnnnnnnnnnnnnnnnnnnnnnnnnnnnnnn

SEQ ID NO: 281679 - DNA, 155 bp, Homo sapiens; identical to SEQ ID NO: 281575
  misc_feature: GYAE6OF01A414Z.1.24.C02.1.454.CMB.1.raw
  modified_base (154)..(155): a, c, t, g, unknown or other
  misc_feature (154)..(155): n is a, c, g, or t

SEQ ID NO: 281680 - DNA, 154 bp, Homo sapiens
  misc_feature: GYAE6OF01AYE15.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgactcgtctctactgagcgggctggcaaggcgcatagn

SEQ ID NO: 281681 - DNA, 154 bp, Homo sapiens
  misc_feature: GYAE6OF01ED8V3.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcatagn

SEQ ID NO: 281682 - DNA, 159 bp, Homo sapiens
  misc_feature: GYAE6OF01DJFRK.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnnnnn

SEQ ID NO: 281683 - DNA, 154 bp, Homo sapiens; identical to SEQ ID NO: 281552
  misc_feature: GYAE6OF01CMS5I.1.24.C02.1.454.CMB.1.raw
  modified_base (154)..(154): a, c, t, g, unknown or other
  misc_feature (154)..(154): n is a, c, g, or t

SEQ ID NO: 281684 - DNA, 154 bp, Homo sapiens; identical to SEQ ID NO: 281552
  misc_feature: GYAE6OF01DQYOB.1.24.C02.1.454.CMB.1.raw
  modified_base (154)..(154): a, c, t, g, unknown or other
  misc_feature (154)..(154): n is a, c, g, or t

SEQ ID NO: 281685 - DNA, 154 bp, Homo sapiens; identical to SEQ ID NO: 281569
  misc_feature: GYAE6OF01BP8GL.1.24.C02.1.454.CMB.1.raw
  modified_base (154)..(154): a, c, t, g, unknown or other
  misc_feature (154)..(154): n is a, c, g, or t

SEQ ID NO: 281686 - DNA, 174 bp, Homo sapiens
  misc_feature: GYAE6OF01B454U.1.24.C02.1.454.CMB.1.raw
  modified_base (154)..(174): a, c, t, g, unknown or other
  misc_feature (154)..(174): n is a, c, g, or t
tcagacgagtgcgtcacgaccggtgctcgatttagtacagatcgttagggaagggaccaaggtggagatcaaacgaactgtggctgcaccatctgtcttcatcttccgccagtctgaatagcgtactctgagcgggctgggcaaggcgcatagnnnnnnnnnnnnnnnnnnnnn

SEQ ID NO: 281687 - DNA, 149 bp, Homo sapiens
  misc_feature: GYAE6OF01AHG9L.1.24.C02.1.454.CMB.1.raw
  modified_base (145)..(145): a, c, t, g, unknown or other
  misc_feature (145)..(145): n is a, c, g, or t
  modified_base (149)..(149): a, c, t, g, unknown or other
  misc_feature (149)..(149): n is a, c, g, or t
tcagacgagtgcgtcacgaccggtgctcgattagtacagatcgttagggaaggaccaaggtggagatacaaacgactgtggctgcaccatctgtcttcatcctccgcatctgatatacgatcgctggaggcggctggacaaggcnatgn

SEQ ID NO: 281688 - DNA, 154 bp, Homo sapiens; identical to SEQ ID NO: 281598
  misc_feature: GYAE6OF01ENQX4.1.24.C02.1.454.CMB.1.raw
  modified_base (154)..(154): a, c, t, g, unknown or other
  misc_feature (154)..(154): n is a, c, g, or t

SEQ ID NO: 281689 - DNA, 154 bp, Homo sapiens; identical to SEQ ID NO: 281569
  misc_feature: GYAE6OF01DWVG6.1.24.C02.1.454.CMB.1.raw
  modified_base (154)..(154): a, c, t, g, unknown or other
  misc_feature (154)..(154): n is a, c, g, or t

SEQ ID NO: 281690 - DNA, 154 bp, Homo sapiens; identical to SEQ ID NO: 281572
  misc_feature: GYAE6OF01AORBQ.1.24.C02.1.454.CMB.1.raw
  modified_base (154)..(154): a, c, t, g, unknown or other
  misc_feature (154)..(154): n is a, c, g, or t

SEQ ID NO: 281691 - DNA, 157 bp, Homo sapiens
  misc_feature: GYAE6OF01CVMHF.1.24.C02.1.454.CMB.1.raw
  modified_base (152)..(157): a, c, t, g, unknown or other
  misc_feature (152)..(157): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcggctggcaaggcgcatagnnnnnn

SEQ ID NO: 281692 - DNA, 154 bp, Homo sapiens; identical to SEQ ID NO: 281569
  misc_feature: GYAE6OF01BIY7A.1.24.C02.1.454.CMB.1.raw
  modified_base (154)..(154): a, c, t, g, unknown or other
  misc_feature (154)..(154): n is a, c, g, or t

SEQ ID NO: 281693 - DNA, 155 bp, Homo sapiens
  misc_feature: GYAE6OF01BLLKB.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnn

SEQ ID NO: 281694 - DNA, 154 bp, Homo sapiens; identical to SEQ ID NO: 281607
  misc_feature: GYAE6OF01B0RYJ.1.24.C02.1.454.CMB.1.raw
  modified_base (154)..(154): a, c, t, g, unknown or other
  misc_feature (154)..(154): n is a, c, g, or t

SEQ ID NO: 281695 - DNA, 154 bp, Homo sapiens; identical to SEQ ID NO: 281604
  misc_feature: GYAE6OF01DX7CY.1.24.C02.1.454.CMB.1.raw
  modified_base (154)..(154): a, c, t, g, unknown or other
  misc_feature (154)..(154): n is a, c, g, or t

SEQ ID NO: 281696 - DNA, 163 bp, Homo sapiens
  misc_feature: GYAE6OF01CXH50.1.24.C02.1.454.CMB.1.raw
  modified_base (153)..(163): a, c, t, g, unknown or other
  misc_feature (153)..(163): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgatatacgatcgctgagcgggctggcaaggcgcatagnnnnnnnnnnn

SEQ ID NO: 281697 - DNA, 155 bp, Homo sapiens
  misc_feature: GYAE6OF01CQ12D.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatcgtagcactctgagcgggctggcaaggcgcatagnn

SEQ ID NO: 281698 - DNA, 154 bp, Homo sapiens; identical to SEQ ID NO: 281552
  misc_feature: GYAE6OF01BFPK0.1.24.C02.1.454.CMB.1.raw
  modified_base (154)..(154): a, c, t, g, unknown or other
  misc_feature (154)..(154): n is a, c, g, or t

SEQ ID NO: 281699 - DNA, 156 bp, Homo sapiens; identical to SEQ ID NO: 281595
  misc_feature: GYAE6OF01E0FRN.1.24.C02.1.454.CMB.1.raw
  modified_base (154)..(156): a, c, t, g, unknown or other
  misc_feature (154)..(156): n is a, c, g, or t

SEQ ID NO: 281700 - DNA, 155 bp, Homo sapiens; identical to SEQ ID NO: 281591
  misc_feature: GYAE6OF01EOKZM.1.24.C02.1.454.CMB.1.raw
  modified_base (154)..(155): a, c, t, g, unknown or other
  misc_feature (154)..(155): n is a, c, g, or t

SEQ ID NO: 281701 - DNA, 166 bp, Homo sapiens
  misc_feature: GYAE6OF01BS8X2.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggcgaagggaccaaggtgtagatcaaacgaactgtggctgcaccatctgtcttcatcttcccgccatctgaatagcgtactctgagcgggctggcaaggcgcatagnnnnnnnnnnnn

SEQ ID NO: 281702 - DNA, 154 bp, Homo sapiens; identical to SEQ ID NO: 281552
  misc_feature: GYAE6OF01A9MSV.1.24.C02.1.454.CMB.1.raw
  modified_base (154)..(154): a, c, t, g, unknown or other
  misc_feature (154)..(154): n is a, c, g, or t

SEQ ID NO: 281703 - DNA, 192 bp, Homo sapiens
  misc_feature: GYAE6OF01DXDKP.1.24.C02.1.454.CMB.1.raw
  modified_base (143)..(143): a, c, t, g, unknown or other
  misc_feature (143)..(143): n is a, c, g, or t
  modified_base (149)..(192): a, c, t, g, unknown or other
  misc_feature (149)..(192): n is a, c, g, or t
tcagacgagtgcgtcacgaccggtgctcgatttagtacagatcgttaggcaagggaccaaggtggagatcaaacgactgtggctgcaccatctgtcttcatcttccgcatctgaatagcgtactctgagcggctggcaaggcncatagnnnnnnnnnnnnnnnnnnnnnnnnnnnnnnnnnnnnnnnnnnnn

SEQ ID NO: 281704 - DNA, 155 bp, Homo sapiens; identical to SEQ ID NO: 281675
  misc_feature: GYAE6OF01CIV56.1.24.C02.1.454.CMB.1.raw
  modified_base (154)..(155): a, c, t, g, unknown or other
  misc_feature (154)..(155): n is a, c, g, or t

SEQ ID NO: 281705 - DNA, 154 bp, Homo sapiens; identical to SEQ ID NO: 281552
  misc_feature: GYAE6OF01AZDZB.1.24.C02.1.454.CMB.1.raw
  modified_base (154)..(154): a, c, t, g, unknown or other
  misc_feature (154)..(154): n is a, c, g, or t

SEQ ID NO: 281706 - DNA, 154 bp, Homo sapiens
  misc_feature: GYAE6OF01A6Q61.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatcgtagcactctgagcgggctggcaaggcgcatagn

SEQ ID NO: 281707 - DNA, 152 bp, Homo sapiens
  misc_feature: GYAE6OF01CY22X.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaagggaccaaggtggagatcaaacgaactgtggctgcaccatctgtcttcatcttccgccatctgaacgcactcgtctgagcgggctggcaaggcgcatagn

SEQ ID NO: 281708 - DNA, 154 bp, Homo sapiens
  misc_feature: GYAE6OF01DKEJQ.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgataacgatcgctgagcgggctggcaaggcgcatagnn

SEQ ID NO: 281709 - DNA, 154 bp, Homo sapiens; identical to SEQ ID NO: 281614
  misc_feature: GYAE6OF01DS1CX.1.24.C02.1.454.CMB.1.raw
  modified_base (154)..(154): a, c, t, g, unknown or other
  misc_feature (154)..(154): n is a, c, g, or t

SEQ ID NO: 281710 - DNA, 213 bp, Homo sapiens
  misc_feature: GYAE6OF01A6A0A.1.24.C02.1.454.CMB.1.raw
  modified_base (152)..(152): a, c, t, g, unknown or other
  misc_feature (152)..(152): n is a, c, g, or t
  modified_base (158)..(213): a, c, t, g, unknown or other
  misc_feature (158)..(213): n is a, c, g, or t
tcagacgagtgcgtcacgaccggtgctcgatttagtacagatcgttagggcgaagggaccaaggtgtagatcaaacgaactgtcggctgcaccatctcgtcttcatcttcccgcatctgaattgcgtactctgagcgggctgggccaaggcncatagnnnnnnnnnnnnnnnnnnnnnnnnnnnnnnnnnnnnnnnnnnnnnnnnnnnnnnnn

SEQ ID NO: 281711 - DNA, 155 bp, Homo sapiens; identical to SEQ ID NO: 281555
  misc_feature: GYAE6OF01CMJJT.1.24.C02.1.454.CMB.1.raw
  modified_base (154)..(155): a, c, t, g, unknown or other
  misc_feature (154)..(155): n is a, c, g, or t

SEQ ID NO: 281712 - DNA, 165 bp, Homo sapiens
  misc_feature: GYAE6OF01C9VKQ.1.24.C02.1.454.CMB.1.raw
  modified_base (154)..(165): a, c, t, g, unknown or other
  misc_feature (154)..(165): n is a, c, g, or t
tcagacgagtgcgtcacgaccggtgctcgatttagtacagatcgttagtgcaagggaccaaggtggagatcaaacgaactgtggctgcaccatctgtcttcatcttcccgccatctgactcgtctctactgagcgggctggcaaggcgcatagnnnnnnnnnnnn

SEQ ID NO: 281713 - DNA, 158 bp, Homo sapiens
  misc_feature: GYAE6OF01BQ7N1.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnn

SEQ ID NO: 281714 - DNA, 160 bp, Homo sapiens
  misc_feature: GYAE6OF01ETYJA.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnn

SEQ ID NO: 281715 - DNA, 156 bp, Homo sapiens
  misc_feature: GYAE6OF01BG96F.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactgtctgagcgggctggcaaggcgcatagnnnn

SEQ ID NO: 281716 - DNA, 152 bp, Homo sapiens
  misc_feature: GYAE6OF01BUNHG.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaagggaccaaggtggaatcaaacgaactgtggctgcaccatctgtcttcatcttcccaccctcctcacgcactcgtctgagcgggctggcaaggcgcatagn

SEQ ID NO: 281717 - DNA, 166 bp, Homo sapiens
  misc_feature: GYAE6OF01BM659.1.24.C02.1.454.CMB.1.raw
  modified_base (154)..(166): a, c, t, g, unknown or other
  misc_feature (154)..(166): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnnnnnnnnnn

SEQ ID NO: 281718 - DNA, 196 bp, Homo sapiens
  misc_feature: GYAE6OF01EIY0G.1.24.C02.1.454.CMB.1.raw
  modified_base (155)..(196): a, c, t, g, unknown or other
  misc_feature (155)..(196): n is a, c, g, or t
tcagacgagtgcgtcacgaccggtgctcgatttagtacagatcgttagggcaagggaccaaggtggagatcaaacgaactgtggctgcaccatcgtgtcttcatcttacccgcatctgatatgtatactctgagcgggctggcaaggcgcatagnnnnnnnnnnnnnnnnnnnnnnnnnnnnnnnnnnnnnnnnnn

SEQ ID NO: 281719 - DNA, 155 bp, Homo sapiens; identical to SEQ ID NO: 281555
  misc_feature: GYAE6OF01B16EE.1.24.C02.1.454.CMB.1.raw
  modified_base (154)..(155): a, c, t, g, unknown or other
  misc_feature (154)..(155): n is a, c, g, or t

SEQ ID NO: 281720 - DNA, 150 bp, Homo sapiens; identical to SEQ ID NO: 281550
  misc_feature: GYAE6OF01CN5R0.1.24.C02.1.454.CMB.1.raw
  modified_base (150)..(150): a, c, t, g, unknown or other
  misc_feature (150)..(150): n is a, c, g, or t

SEQ ID NO: 281721 - DNA, 154 bp, Homo sapiens; identical to SEQ ID NO: 281569
  misc_feature: GYAE6OF01B8UQP.1.24.C02.1.454.CMB.1.raw
  modified_base (154)..(154): a, c, t, g, unknown or other
  misc_feature (154)..(154): n is a, c, g, or t

SEQ ID NO: 281722 - DNA, 154 bp, Homo sapiens; identical to SEQ ID NO: 281641
  misc_feature: GYAE6OF01AXI6I.1.24.C02.1.454.CMB.1.raw
  modified_base (154)..(154): a, c, t, g, unknown or other
  misc_feature (154)..(154): n is a, c, g, or t

SEQ ID NO: 281723 - DNA, 152 bp, Homo sapiens
  misc_feature: GYAE6OF01BA528.1.24.C02.1.454.CMB.1.raw
  modified_base (151)..(152): a, c, t, g, unknown or other
  misc_feature (151)..(152): n is a, c, g, or t
tcagacgagtgcgtcacgaccggtgctcgatttagtacagatcgttagggaaggaccaaggtggagatcaacgaactgtggctgcaccatctgtcttcatcttcccgccatctgatcgtagcactctgagcgggctggcaaggcgcatagnn

SEQ ID NO: 281724 - DNA, 154 bp, Homo sapiens; identical to SEQ ID NO: 281552
  misc_feature: GYAE6OF01DD0SB.1.24.C02.1.454.CMB.1.raw
  modified_base (154)..(154): a, c, t, g, unknown or other
  misc_feature (154)..(154): n is a, c, g, or t

SEQ ID NO: 281725 - DNA, 154 bp, Homo sapiens; identical to SEQ ID NO: 281604
  misc_feature: GYAE6OF01CM8S4.1.24.C02.1.454.CMB.1.raw
  modified_base (154)..(154): a, c, t, g, unknown or other
  misc_feature (154)..(154): n is a, c, g, or t

SEQ ID NO: 281726 - DNA, 155 bp, Homo sapiens
  misc_feature: GYAE6OF01DPHQF.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgcctcctcacgtctactgctgagcgggctggcaaggcgcatagnnn

SEQ ID NO: 281727 - DNA, 153 bp, Homo sapiens
  misc_feature: GYAE6OF01D5ASY.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatcttcccgccatcgaatagcgtactctgagcgggctggcaaggcgcatagn

SEQ ID NO: 281728 - DNA, 157 bp, Homo sapiens
  misc_feature: GYAE6OF01DKL0N.1.24.C02.1.454.CMB.1.raw
  modified_base (156)..(157): a, c, t, g, unknown or other
  misc_feature (156)..(157): n is a, c, g, or t
tcagacgagtgcgtcacgaccggtgctcgatttagtacagatcgttagggaaggacgaacgtaggagatcaaacgaaactagtggcgtgcaccatctgtcttcatcttcccgccatctgaatagcgtactctgagcgggctggcaaggcgcatagnn

SEQ ID NO: 281729 - DNA, 159 bp, Homo sapiens
  misc_feature: GYAE6OF01B7PRF.1.24.C02.1.454.CMB.1.raw
  modified_base (153)..(159): a, c, t, g, unknown or other
  misc_feature (153)..(159): n is a, c, g, or t
tcagacgagtgcgtcacgaccggtgctcgatttagtacagatcgttagggcaagggaccaaggtggagatcaaacgaactgtggctgaaccatctgtcttcatcttccgccatctgaatagcgtactctgagcgggctggcaaggcgcatagnnnnnnn

SEQ ID NO: 281730 - DNA, 167 bp, Homo sapiens
  misc_feature: GYAE6OF01CD511.1.24.C02.1.454.CMB.1.raw
  modified_base (157)..(167): a, c, t, g, unknown or other
  misc_feature (157)..(167): n is a, c, g, or t
tcagacgagtgcgtcacgaccggtgctcgatttagtacagatcgttagggaaagggaccaaggtggagatctaaacgaactgtggctgacaccatctgtcttcatcttcccgccatctgagtatacgatcgctgagcgggctggcaaggcgcatagnnnnnnnnnnn

SEQ ID NO: 281731 - DNA, 156 bp, Homo sapiens; identical to SEQ ID NO: 281661
  misc_feature: GYAE6OF01ANZ4L.1.24.C02.1.454.CMB.1.raw
  modified_base (154)..(156): a, c, t, g, unknown or other
  misc_feature (154)..(156): n is a, c, g, or t

SEQ ID NO: 281732 - DNA, 155 bp, Homo sapiens; identical to SEQ ID NO: 281693
  misc_feature: GYAE6OF01CF2SV.1.24.C02.1.454.CMB.1.raw
  modified_base (154)..(155): a, c, t, g, unknown or other
  misc_feature (154)..(155): n is a, c, g, or t

SEQ ID NO: 281733 - DNA, 154 bp, Homo sapiens; identical to SEQ ID NO: 281569
  misc_feature: GYAE6OF01CU80K.1.24.C02.1.454.CMB.1.raw
  modified_base (154)..(154): a, c, t, g, unknown or other
  misc_feature (154)..(154): n is a, c, g, or t

SEQ ID NO: 281734 - DNA, 154 bp, Homo sapiens
  misc_feature: GYAE6OF01AMFW2.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtctactgctgagcgggctggcaaggcgcatagn

SEQ ID NO: 281735 - DNA, 154 bp, Homo sapiens; identical to SEQ ID NO: 281552
  misc_feature: GYAE6OF01C2UD8.1.24.C02.1.454.CMB.1.raw
  modified_base (154)..(154): a, c, t, g, unknown or other
  misc_feature (154)..(154): n is a, c, g, or t

SEQ ID NO: 281736 - DNA, 154 bp, Homo sapiens; identical to SEQ ID NO: 281569
  misc_feature: GYAE6OF01B0FVA.1.24.C02.1.454.CMB.1.raw
  modified_base (154)..(154): a, c, t, g, unknown or other
  misc_feature (154)..(154): n is a, c, g, or t

SEQ ID NO: 281737 - DNA, 157 bp, Homo sapiens; identical to SEQ ID NO: 281599
  misc_feature: GYAE6OF01ATGSN.1.24.C02.1.454.CMB.1.raw
  modified_base (154)..(157): a, c, t, g, unknown or other
  misc_feature (154)..(157): n is a, c, g, or t

SEQ ID NO: 281738 - DNA, 154 bp, Homo sapiens; identical to SEQ ID NO: 281706
  misc_feature: GYAE6OF01BBWJ2.1.24.C02.1.454.CMB.1.raw
  modified_base (154)..(154): a, c, t, g, unknown or other
  misc_feature (154)..(154): n is a, c, g, or t

SEQ ID NO: 281739 - DNA, 155 bp, Homo sapiens
  misc_feature: GYAE6OF01CEIFF.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaactaactgtggctgcaccatctgtcttcatcttcccgccatctgatcgtactgcgctgagcgggctggcaaggcgcatagnn

SEQ ID NO: 281740 - DNA, 153 bp, Homo sapiens; identical to SEQ ID NO: 281596
  misc_feature: GYAE6OF01ACMIW.1.24.C02.1.454.CMB.1.raw
  modified_base (153)..(153): a, c, t, g, unknown or other
  misc_feature (153)..(153): n is a, c, g, or t

SEQ ID NO: 281741 - DNA, 156 bp, Homo sapiens
  misc_feature: GYAE6OF01CPJLE.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnn

SEQ ID NO: 281742 - DNA, 155 bp, Homo sapiens; identical to SEQ ID NO: 281555
  misc_feature: GYAE6OF01CRDK0.1.24.C02.1.454.CMB.1.raw
  modified_base (154)..(155): a, c, t, g, unknown or other
  misc_feature (154)..(155): n is a, c, g, or t

SEQ ID NO: 281743 - DNA, 164 bp, Homo sapiens
  misc_feature: GYAE6OF01CEXRR.1.24.C02.1.454.CMB.1.raw
  modified_base (155)..(164): a, c, t, g, unknown or other
  misc_feature (155)..(164): n is a, c, g, or t
tcagacgagtgcgtcacgaccggtgctcgatttagtacagatcgttagggaagggaccgaaggtggtagatcaaacgaactgtggctgcaccatctgtcttcatcttcccgccatctgaacgcactcgtctgagcgggctggcaaggcgcatagnnnnnnnnnn

SEQ ID NO: 281744 - DNA, 154 bp, Homo sapiens; identical to SEQ ID NO: 281604
  misc_feature: GYAE6OF01DND3X.1.24.C02.1.454.CMB.1.raw
  modified_base (154)..(154): a, c, t, g, unknown or other
  misc_feature (154)..(154): n is a, c, g, or t

SEQ ID NO: 281745 - DNA, 154 bp, Homo sapiens; identical to SEQ ID NO: 281609
  misc_feature: GYAE6OF01B5LL3.1.24.C02.1.454.CMB.1.raw
  modified_base (154)..(154): a, c, t, g, unknown or other
  misc_feature (154)..(154): n is a, c, g, or t

SEQ ID NO: 281746 - DNA, 154 bp, Homo sapiens; identical to SEQ ID NO: 281552
  misc_feature: GYAE6OF01EH7V9.1.24.C02.1.454.CMB.1.raw
  modified_base (154)..(154): a, c, t, g, unknown or other
  misc_feature (154)..(154): n is a, c, g, or t

SEQ ID NO: 281747 - DNA, 163 bp, Homo sapiens
  misc_feature: GYAE6OF01DSWAO.1.24.C02.1.454.CMB.1.raw
  modified_base (154)..(163): a, c, t, g, unknown or other
  misc_feature (154)..(163): n is a, c, g, or t
tcagacgagtgcgtcacgaccggtgctcgatttagtacagatcgttagggaaagggaccgaaggtggagatcaaacgaactgtggctgcaccatctgtcttcatcttcccacctcctcacgcactcgtctgagcgggctggcaaggcgcatagnnnnnnnnnn

SEQ ID NO: 281748 - DNA, 156 bp, Homo sapiens
  misc_feature: GYAE6OF01C4NT5.1.24.C02.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtacagatcgttagggaaagggaccgaaggtggagatcaaactaactgtggctgcaccatctgtcttcatcttcccgccatctgatcgtactgcgctgagcgggctggcaaggcgcatagnn

SEQ ID NO: 281749 - DNA, 154 bp, Homo sapiens; identical to SEQ ID NO: 281734
  misc_feature: GYAE6OF01B709H.1.24.C02.1.454.CMB.1.raw
  modified_base (154)..(154): a, c, t, g, unknown or other
  misc_feature (154)..(154): n is a, c, g, or t

SEQ ID NO: 281750 - DNA, 157 bp, Homo sapiens; identical to SEQ ID NO: 281599
  misc_feature: GYAE6OF01AZVBY.1.24.C02.1.454.CMB.1.raw
  modified_base (154)..(157): a, c, t, g, unknown or other
  misc_feature (154)..(157): n is a, c, g, or t

SEQ ID NO: 281751 - DNA, 154 bp, Homo sapiens; identical to SEQ ID NO: 281552
  misc_feature: GYAE6OF01B6ZME.1.24.C02.1.454.CMB.1.raw
  modified_base (154)..(154): a, c, t, g, unknown or other
  misc_feature (154)..(154): n is a, c, g, or t

SEQ ID NO: 281752 - DNA, 154 bp, Homo sapiens; identical to SEQ ID NO: 281569
  misc_feature: GYAE6OF01AG3D2.1.24.C02.1.454.CMB.1.raw
  modified_base (154)..(154): a, c, t, g, unknown or other
  misc_feature (154)..(154): n is a, c, g, or t

SEQ ID NO: 281753 - DNA, 155 bp, Homo sapiens
  misc_feature: GYAE6OF01BNYIT.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatagnn

SEQ ID NO: 281754 - DNA, 154 bp, Homo sapiens; identical to SEQ ID NO: 281706
  misc_feature: GYAE6OF01B8GFM.1.24.C02.1.454.CMB.1.raw
  modified_base (154)..(154): a, c, t, g, unknown or other
  misc_feature (154)..(154): n is a, c, g, or t

SEQ ID NO: 281755 - DNA, 150 bp, Homo sapiens
  misc_feature: GYAE6OF01A0EUI.1.24.C02.1.454.CMB.1.raw
  modified_base (150)..(150): a, c, t, g, unknown or other
  misc_feature (150)..(150): n is a, c, g, or t
tcagacgagtgcgtcacgaccggtgctcgatttagtacagatcgttaggcaaggaccaaggtggagatcaacgaactgtggctgcaccatctgtcttcatcttccgccatctgatatgtatactctgagcgggctggcaaggcgcatagn

SEQ ID NO: 281756 - DNA, 154 bp, Homo sapiens
  misc_feature: GYAE6OF01EK349.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaatgtggagatcaaacgaactgtggctgcaccatctgtcttcatcttcccgccatctgaatagcgtactctgagcgggctggcaaggcgcatagn

SEQ ID NO: 281757 - DNA, 154 bp, Homo sapiens
  misc_feature: GYAE6OF01CGVCB.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcggctggcaaggcgcatagnn

SEQ ID NO: 281758 - DNA, 154 bp, Homo sapiens; identical to SEQ ID NO: 281607
  misc_feature: GYAE6OF01AG046.1.24.C02.1.454.CMB.1.raw
  modified_base (154)..(154): a, c, t, g, unknown or other
  misc_feature (154)..(154): n is a, c, g, or t

SEQ ID NO: 281759 - DNA, 157 bp, Homo sapiens; identical to SEQ ID NO: 281599
  misc_feature: GYAE6OF01CALRY.1.24.C02.1.454.CMB.1.raw
  modified_base (154)..(157): a, c, t, g, unknown or other
  misc_feature (154)..(157): n is a, c, g, or t

SEQ ID NO: 281760 - DNA, 154 bp, Homo sapiens; identical to SEQ ID NO: 281552
  misc_feature: GYAE6OF01A5TMH.1.24.C02.1.454.CMB.1.raw
  modified_base (154)..(154): a, c, t, g, unknown or other
  misc_feature (154)..(154): n is a, c, g, or t

SEQ ID NO: 281761 - DNA, 166 bp, Homo sapiens
  misc_feature: GYAE6OF01DVVND.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggcgaagggaccaaggtggagatcaaacgaactgtggctgaaccatctgtcttcatcttcccgccatctgaatagcgtactctgagcgggctggcaaggcgcatagnnnnnnnnnnnn

SEQ ID NO: 281762 - DNA, 156 bp, Homo sapiens
  misc_feature: GYAE6OF01EC8JG.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnn

SEQ ID NO: 281763 - DNA, 154 bp, Homo sapiens; identical to SEQ ID NO: 281569
  misc_feature: GYAE6OF01BDLAX.1.24.C02.1.454.CMB.1.raw
  modified_base (154)..(154): a, c, t, g, unknown or other
  misc_feature (154)..(154): n is a, c, g, or t

SEQ ID NO: 281764 - DNA, 155 bp, Homo sapiens
  misc_feature: GYAE6OF01EUVGH.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccctcctcacgtagcgtgctgagcgggctggcaaggcgcatagnn

SEQ ID NO: 281765 - DNA, 154 bp, Homo sapiens; identical to SEQ ID NO: 281609
  misc_feature: GYAE6OF01CSL9K.1.24.C02.1.454.CMB.1.raw
  modified_base (154)..(154): a, c, t, g, unknown or other
  misc_feature (154)..(154): n is a, c, g, or t

SEQ ID NO: 281766 - DNA, 153 bp, Homo sapiens
  misc_feature: GYAE6OF01AZMOL.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttctcttcccgccatctgaatagcgtactctgagcgggctggcaaggcgcatagn

SEQ ID NO: 281767 - DNA, 154 bp, Homo sapiens; identical to SEQ ID NO: 281569
  misc_feature: GYAE6OF01BJAHA.1.24.C02.1.454.CMB.1.raw
  modified_base (154)..(154): a, c, t, g, unknown or other
  misc_feature (154)..(154): n is a, c, g, or t

SEQ ID NO: 281768 - DNA, 154 bp, Homo sapiens
  misc_feature: GYAE6OF01DC4W4.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaatgtggagatcaaacgaactgtggctgcaccatctgtcttcatctttccgccatctgagagtgcgtctctgagcgggctggcaaggcgcatagn

SEQ ID NO: 281769 - DNA, 163 bp, Homo sapiens
  misc_feature: GYAE6OF01C54T4.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggcgaagggaccaaggtggagatcaaacgaactgtggctgaaccatctgtcttcatcttcccgccatctgaatagcgtactctgagcgggctggcaaggcgcatagnnnnnnnnn

SEQ ID NO: 281770 - DNA, 154 bp, Homo sapiens; identical to SEQ ID NO: 281706
  misc_feature: GYAE6OF01BHK0D.1.24.C02.1.454.CMB.1.raw
  modified_base (154)..(154): a, c, t, g, unknown or other
  misc_feature (154)..(154): n is a, c, g, or t

SEQ ID NO: 281771 - DNA, 154 bp, Homo sapiens
  misc_feature: GYAE6OF01CFRPM.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgcactcgtctgagcgggctggcaaggcgcatagn

SEQ ID NO: 281772 - DNA, 156 bp, Homo sapiens
  misc_feature: GYAE6OF01DBIOZ.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcatagnnn

SEQ ID NO: 281773 - DNA, 154 bp, Homo sapiens; identical to SEQ ID NO: 281641
  misc_feature: GYAE6OF01EAWUY.1.24.C02.1.454.CMB.1.raw
  modified_base (154)..(154): a, c, t, g, unknown or other
  misc_feature (154)..(154): n is a, c, g, or t

SEQ ID NO: 281774 - DNA, 160 bp, Homo sapiens
  misc_feature: GYAE6OF01CWA8U.1.24.C02.1.454.CMB.1.raw
  modified_base (152)..(160): a, c, t, g, unknown or other
  misc_feature (152)..(160): n is a, c, g, or t
tcagacgagtgcgtcacgaccggtgctcgatttagtacagatcgttagggcaagggaccaaggtgtagatcaaacgaactgtggctgcaccatctgtcttcatcttccgccatctgaatagcgtactctgagcggctggcaaggcgcatagnnnnnnnnn

SEQ ID NO: 281775 - DNA, 163 bp, Homo sapiens
  misc_feature: GYAE6OF01BPPWK.1.24.C02.1.454.CMB.1.raw
  modified_base (154)..(163): a, c, t, g, unknown or other
  misc_feature (154)..(163): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnnnnnnnnn

SEQ ID NO: 281776 - DNA, 154 bp, Homo sapiens; identical to SEQ ID NO: 281552
  misc_feature: GYAE6OF01AI4SR.1.24.C02.1.454.CMB.1.raw
  modified_base (154)..(154): a, c, t, g, unknown or other
  misc_feature (154)..(154): n is a, c, g, or t

SEQ ID NO: 281777 - DNA, 154 bp, Homo sapiens; identical to SEQ ID NO: 281552
  misc_feature: GYAE6OF01EV5SG.1.24.C02.1.454.CMB.1.raw
  modified_base (154)..(154): a, c, t, g, unknown or other
  misc_feature (154)..(154): n is a, c, g, or t

SEQ ID NO: 281778 - DNA, 154 bp, Homo sapiens; identical to SEQ ID NO: 281609
  misc_feature: GYAE6OF01CCJE8.1.24.C02.1.454.CMB.1.raw
  modified_base (154)..(154): a, c, t, g, unknown or other
  misc_feature (154)..(154): n is a, c, g, or t

SEQ ID NO: 281779 - DNA, 154 bp, Homo sapiens; identical to SEQ ID NO: 281604
  misc_feature: GYAE6OF01DUJE4.1.24.C02.1.454.CMB.1.raw
  modified_base (154)..(154): a, c, t, g, unknown or other
  misc_feature (154)..(154): n is a, c, g, or t

SEQ ID NO: 281780 - DNA, 159 bp, Homo sapiens
  misc_feature: GYAE6OF01D476U.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnnnnn

SEQ ID NO: 281781 - DNA, 154 bp, Homo sapiens; identical to SEQ ID NO: 281572
  misc_feature: GYAE6OF01CH0O2.1.24.C02.1.454.CMB.1.raw
  modified_base (154)..(154): a, c, t, g, unknown or other
  misc_feature (154)..(154): n is a, c, g, or t

SEQ ID NO: 281782 - DNA, 154 bp, Homo sapiens; identical to SEQ ID NO: 281552
  misc_feature: GYAE6OF01DDDRP.1.24.C02.1.454.CMB.1.raw
  modified_base (154)..(154): a, c, t, g, unknown or other
  misc_feature (154)..(154): n is a, c, g, or t

SEQ ID NO: 281783 - DNA, 154 bp, Homo sapiens
  misc_feature: GYAE6OF01DDW8Z.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatactgctagtctgagcgggctggcaaggcgcatagn

SEQ ID NO: 281784 - DNA, 167 bp, Homo sapiens
  misc_feature: GYAE6OF01CIRMI.1.24.C02.1.454.CMB.1.raw
  modified_base (154)..(167): a, c, t, g, unknown or other
  misc_feature (154)..(167): n is a, c, g, or t
tcagacgagtgcgtcacgaccggtgctcgatttagtacagatcgttagggcgaagggaccaaggtgtagatcaaacgaactgtggctgcaccatctgtcttcatcttcccgccatctgaatagcgtctctgagcgggctggcaaggcgcatagnnnnnnnnnnnnnn

SEQ ID NO: 281785 - DNA, 157 bp, Homo sapiens
  misc_feature: GYAE6OF01EB5EO.1.24.C02.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtacagatcgttagggaaagggaccaagggtggagatcaaacgaactgtggctgcaccatctgtcttcatcttcccgccatctgaatagcgtactctgagcgggctggcaaggcgcatagnnn

SEQ ID NO: 281786 - DNA, 161 bp, Homo sapiens
  misc_feature: GYAE6OF01D92F0.1.24.C02.1.454.CMB.1.raw
  modified_base (154)..(161): a, c, t, g, unknown or other
  misc_feature (154)..(161): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnnnnnnn

SEQ ID NO: 281787 - DNA, 155 bp, Homo sapiens; identical to SEQ ID NO: 281555
  misc_feature: GYAE6OF01DJGJM.1.24.C02.1.454.CMB.1.raw
  modified_base (154)..(155): a, c, t, g, unknown or other
  misc_feature (154)..(155): n is a, c, g, or t

SEQ ID NO: 281788 - DNA, 179 bp, Homo sapiens
  misc_feature: GYAE6OF01BI5MQ.1.24.C02.1.454.CMB.1.raw
  modified_base (156)..(179): a, c, t, g, unknown or other
  misc_feature (156)..(179): n is a, c, g, or t
tcagacgagtgcgtcacgaccggtgctcgatttagtacagatcgttagggaaagggtaccgaaggtggagatcaaacgaactgtggctgcaccatctgtcttcatcttcccgccatctgatctctcgactctgagcgggctggcaaggcgcatagnnnnnnnnnnnnnnnnnnnnnnnn

SEQ ID NO: 281789 - DNA, 154 bp, Homo sapiens; identical to SEQ ID NO: 281552
  misc_feature: GYAE6OF01B3JUM.1.24.C02.1.454.CMB.1.raw
  modified_base (154)..(154): a, c, t, g, unknown or other
  misc_feature (154)..(154): n is a, c, g, or t

SEQ ID NO: 281790 - DNA, 154 bp, Homo sapiens; identical to SEQ ID NO: 281609
  misc_feature: GYAE6OF01D27EX.1.24.C02.1.454.CMB.1.raw
  modified_base (154)..(154): a, c, t, g, unknown or other
  misc_feature (154)..(154): n is a, c, g, or t

SEQ ID NO: 281791 - DNA, 155 bp, Homo sapiens; identical to SEQ ID NO: 281575
  misc_feature: GYAE6OF01BSIMT.1.24.C02.1.454.CMB.1.raw
  modified_base (154)..(155): a, c, t, g, unknown or other
  misc_feature (154)..(155): n is a, c, g, or t

SEQ ID NO: 281792 - DNA, 154 bp, Homo sapiens; identical to SEQ ID NO: 281609
  misc_feature: GYAE6OF01EGP3W.1.24.C02.1.454.CMB.1.raw
  modified_base (154)..(154): a, c, t, g, unknown or other
  misc_feature (154)..(154): n is a, c, g, or t

SEQ ID NO: 281793 - DNA, 154 bp, Homo sapiens; identical to SEQ ID NO: 281670
  misc_feature: GYAE6OF01BZKNG.1.24.C02.1.454.CMB.1.raw
  modified_base (154)..(154): a, c, t, g, unknown or other
  misc_feature (154)..(154): n is a, c, g, or t

SEQ ID NO: 281794 - DNA, 154 bp, Homo sapiens; identical to SEQ ID NO: 281644
  misc_feature: GYAE6OF01CGQHR.1.24.C02.1.454.CMB.1.raw
  modified_base (154)..(154): a, c, t, g, unknown or other
  misc_feature (154)..(154): n is a, c, g, or t

SEQ ID NO: 281795 - DNA, 157 bp, Homo sapiens
  misc_feature: GYAE6OF01CJRH0.1.24.C02.1.454.CMB.1.raw
  modified_base (128)..(128): a, c, t, g, unknown or other
  misc_feature (128)..(128): n is a, c, g, or t
  modified_base (156)..(157): a, c, t, g, unknown or other
  misc_feature (156)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgcatcgntgaggcggtcgtgacgaggcgatagagnn

SEQ ID NO: 281796 - DNA, 154 bp, Homo sapiens; identical to SEQ ID NO: 281734
  misc_feature: GYAE6OF01D1133.1.24.C02.1.454.CMB.1.raw
  modified_base (154)..(154): a, c, t, g, unknown or other
  misc_feature (154)..(154): n is a, c, g, or t

SEQ ID NO: 281797 - DNA, 154 bp, Homo sapiens; identical to SEQ ID NO: 281569
  misc_feature: GYAE6OF01BMZ47.1.24.C02.1.454.CMB.1.raw
  modified_base (154)..(154): a, c, t, g, unknown or other
  misc_feature (154)..(154): n is a, c, g, or t

SEQ ID NO: 281798 - DNA, 154 bp, Homo sapiens
  misc_feature: GYAE6OF01CL950.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaagtcgctagactgagcgggctggcaaggcgcatagn

SEQ ID NO: 281799 - DNA, 155 bp, Homo sapiens
  misc_feature: GYAE6OF01BXSK5.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnn

SEQ ID NO: 281800 - DNA, 156 bp, Homo sapiens; identical to SEQ ID NO: 281661
  misc_feature: GYAE6OF01CGMC3.1.24.C02.1.454.CMB.1.raw
  modified_base (154)..(156): a, c, t, g, unknown or other
  misc_feature (154)..(156): n is a, c, g, or t

SEQ ID NO: 281801 - DNA, 154 bp, Homo sapiens; identical to SEQ ID NO: 281614
  misc_feature: GYAE6OF01AVVF5.1.24.C02.1.454.CMB.1.raw
  modified_base (154)..(154): a, c, t, g, unknown or other
  misc_feature (154)..(154): n is a, c, g, or t

SEQ ID NO: 281802 - DNA, 154 bp, Homo sapiens; identical to SEQ ID NO: 281572
  misc_feature: GYAE6OF01E1JJK.1.24.C02.1.454.CMB.1.raw
  modified_base (154)..(154): a, c, t, g, unknown or other
  misc_feature (154)..(154): n is a, c, g, or t

SEQ ID NO: 281803 - DNA, 155 bp, Homo sapiens; identical to SEQ ID NO: 281555
  misc_feature: GYAE6OF01CKZC2.1.24.C02.1.454.CMB.1.raw
  modified_base (154)..(155): a, c, t, g, unknown or other
  misc_feature (154)..(155): n is a, c, g, or t

SEQ ID NO: 281804 - DNA, 154 bp, Homo sapiens; identical to SEQ ID NO: 281569
  misc_feature: GYAE6OF01AXVWQ.1.24.C02.1.454.CMB.1.raw
  modified_base (154)..(154): a, c, t, g, unknown or other
  misc_feature (154)..(154): n is a, c, g, or t

SEQ ID NO: 281805 - DNA, 154 bp, Homo sapiens; identical to SEQ ID NO: 281616
  misc_feature: GYAE6OF01A45J5.1.24.C02.1.454.CMB.1.raw
  modified_base (154)..(154): a, c, t, g, unknown or other
  misc_feature (154)..(154): n is a, c, g, or t

SEQ ID NO: 281806 - DNA, 154 bp, Homo sapiens; identical to SEQ ID NO: 281569
  misc_feature: GYAE6OF01DJJJ1.1.24.C02.1.454.CMB.1.raw
  modified_base (154)..(154): a, c, t, g, unknown or other
  misc_feature (154)..(154): n is a, c, g, or t

SEQ ID NO: 281807 - DNA, 158 bp, Homo sapiens
  misc_feature: GYAE6OF01DFKWC.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagnnnnn

SEQ ID NO: 281808 - DNA, 154 bp, Homo sapiens; identical to SEQ ID NO: 281604
  misc_feature: GYAE6OF01EFT04.1.24.C02.1.454.CMB.1.raw
  modified_base (154)..(154): a, c, t, g, unknown or other
  misc_feature (154)..(154): n is a, c, g, or t

SEQ ID NO: 281809 - DNA, 153 bp, Homo sapiens
  misc_feature: GYAE6OF01BCZO3.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaagggaccaaggtggagatcaaacgaactgtggctgcaccatctgtcttcatcttccgccatctgaacgcactcgtctgagcgggctggcaaggcgcatagnn

SEQ ID NO: 281810 - DNA, 155 bp, Homo sapiens; identical to SEQ ID NO: 281555
  misc_feature: GYAE6OF01DO1GJ.1.24.C02.1.454.CMB.1.raw
  modified_base (154)..(155): a, c, t, g, unknown or other
  misc_feature (154)..(155): n is a, c, g, or t

SEQ ID NO: 281811 - DNA, 174 bp, Homo sapiens
  misc_feature: GYAE6OF01E21DT.1.24.C02.1.454.CMB.1.raw
  modified_base (155)..(174): a, c, t, g, unknown or other
  misc_feature (155)..(174): n is a, c, g, or t
tcagacgagtgcgtcacgaccggtgctcgatttagtacagatcgttagggaaagggaccaaggtgggagatcaaacgaactgttgctgcaccatctgtcttcatcttcccgccatctgatcgtagcactctgagcgggctggcaaggcgcatagnnnnnnnnnnnnnnnnnnnn

SEQ ID NO: 281812 - DNA, 155 bp, Homo sapiens; identical to SEQ ID NO: 281555
  misc_feature: GYAE6OF01DT2JF.1.24.C02.1.454.CMB.1.raw
  modified_base (154)..(155): a, c, t, g, unknown or other
  misc_feature (154)..(155): n is a, c, g, or t

SEQ ID NO: 281813 - DNA, 154 bp, Homo sapiens; identical to SEQ ID NO: 281552
  misc_feature: GYAE6OF01CGTPN.1.24.C02.1.454.CMB.1.raw
  modified_base (154)..(154): a, c, t, g, unknown or other
  misc_feature (154)..(154): n is a, c, g, or t

SEQ ID NO: 281814 - DNA, 155 bp, Homo sapiens; identical to SEQ ID NO: 281555
  misc_feature: GYAE6OF01EMWCC.1.24.C02.1.454.CMB.1.raw
  modified_base (154)..(155): a, c, t, g, unknown or other
  misc_feature (154)..(155): n is a, c, g, or t

SEQ ID NO: 281815 - DNA, 164 bp, Homo sapiens
  misc_feature: GYAE6OF01CD5IX.1.24.C02.1.454.CMB.1.raw
  modified_base (155)..(164): a, c, t, g, unknown or other
  misc_feature (155)..(164): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgaatagcgtactctgagcgggctggcaaggcgcatagnnnnnnnnnn

SEQ ID NO: 281816 - DNA, 177 bp, Homo sapiens
  misc_feature: GYAE6OF01COEYU.1.24.C02.1.454.CMB.1.raw
  modified_base (155)..(157): a, c, t, g, unknown or other
  misc_feature (155)..(157): n is a, c, g, or t
  modified_base (159)..(177): a, c, t, g, unknown or other
  misc_feature (159)..(177): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgatatgtatactctgagcgggctggcaaggcgcatagnnntnnnnnnnnnnnnnnnnnnn

SEQ ID NO: 281817 - DNA, 154 bp, Homo sapiens; identical to SEQ ID NO: 281614
  misc_feature: GYAE6OF01CG9C9.1.24.C02.1.454.CMB.1.raw
  modified_base (154)..(154): a, c, t, g, unknown or other
  misc_feature (154)..(154): n is a, c, g, or t

SEQ ID NO: 281818 - DNA, 156 bp, Homo sapiens
  misc_feature: GYAE6OF01BKGBE.1.24.C02.1.454.CMB.1.raw
tcagacgagtgcgtcacgaccggtgctcgatttagtacagatcgttagggacgaaggaccaaggtggagatcaaacgaactgtaggactgcaccatctgtcttcatcttcccgccatctgaatagcgtactctgagcgggctggcaaggcgcatag

SEQ ID NO: 281819 - DNA, 154 bp, Homo sapiens; identical to SEQ ID NO: 281572
  misc_feature: GYAE6OF01ENKF6.1.24.C02.1.454.CMB.1.raw
  modified_base (154)..(154): a, c, t, g, unknown or other
  misc_feature (154)..(154): n is a, c, g, or t

SEQ ID NO: 281820 - DNA, 154 bp, Homo sapiens; identical to SEQ ID NO: 281641
  misc_feature: GYAE6OF01D5QZJ.1.24.C02.1.454.CMB.1.raw
  modified_base (154)..(154): a, c, t, g, unknown or other
  misc_feature (154)..(154): n is a, c, g, or t

SEQ ID NO: 281821 - DNA, 154 bp, Homo sapiens; identical to SEQ ID NO: 281569
  misc_feature: GYAE6OF01DYP3Z.1.24.C02.1.454.CMB.1.raw
  modified_base (154)..(154): a, c, t, g, unknown or other
  misc_feature (154)..(154): n is a, c, g, or t

SEQ ID NO: 281822 - DNA, 154 bp, Homo sapiens; identical to SEQ ID NO: 281552
  misc_feature: GYAE6OF01CVLLK.1.24.C02.1.454.CMB.1.raw
  modified_base (154)..(154): a, c, t, g, unknown or other
  misc_feature (154)..(154): n is a, c, g, or t

SEQ ID NO: 281823 - DNA, 154 bp, Homo sapiens; identical to SEQ ID NO: 281552
  misc_feature: GYAE6OF01AV32X.1.24.C02.1.454.CMB.1.raw
  modified_base (154)..(154): a, c, t, g, unknown or other
  misc_feature (154)..(154): n is a, c, g, or t

SEQ ID NO: 281824 - DNA, 154 bp, Homo sapiens; identical to SEQ ID NO: 281671
  misc_feature: GYAE6OF01BW3F7.1.24.C02.1.454.CMB.1.raw
  modified_base (154)..(154): a, c, t, g, unknown or other
  misc_feature (154)..(154): n is a, c, g, or t

SEQ ID NO: 281825 - DNA, 155 bp, Homo sapiens
  misc_feature: GYAE6OF01D1S8S.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtagcgtgctgagcgggctggcaaggcgcatagnn

SEQ ID NO: 281826 - DNA, 180 bp, Homo sapiens
  misc_feature: GYAE6OF01BV23K.1.24.C02.1.454.CMB.1.raw
  modified_base (156)..(180): a, c, t, g, unknown or other
  misc_feature (156)..(180): n is a, c, g, or t
tcagacgagtgcgtcacgaccggtgctcgatttagtacagatcgttagggcaagggaccgaaggtggagatcaaacgaactgtggctgcaccatctgtcttcatcttcccgccatctgaatagcgtactctgagcgggctggcaaggtcgcatagnnnnnnnnnnnnnnnnnnnnnnnnn

SEQ ID NO: 281827 - DNA, 169 bp, Homo sapiens
  misc_feature: GYAE6OF01D46ZX.1.24.C02.1.454.CMB.1.raw
  modified_base (155)..(169): a, c, t, g, unknown or other
  misc_feature (155)..(169): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgtcatagnnnnnnnnnnnnnnn

SEQ ID NO: 281828 - DNA, 169 bp, Homo sapiens
  misc_feature: GYAE6OF01DBJAS.1.24.C02.1.454.CMB.1.raw
  modified_base (155)..(169): a, c, t, g, unknown or other
  misc_feature (155)..(169): n is a, c, g, or t
tcagacgagtgcgtcacgaccggtgctcgatttagtacagatcgttagggaaagggaccaaggtggagatcaaacgaactgtggctgcaccatctgtcttcatcttcccgccatcctgaatagcgtactctgagcgggctggcaaggcgcatagnnnnnnnnnnnnnnn

SEQ ID NO: 281829 - DNA, 172 bp, Homo sapiens
  misc_feature: GYAE6OF01BIIXZ.1.24.C02.1.454.CMB.1.raw
  modified_base (155)..(172): a, c, t, g, unknown or other
  misc_feature (155)..(172): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcattagnnnnnnnnnnnnnnnnnn

SEQ ID NO: 281830 - DNA, 154 bp, Homo sapiens; identical to SEQ ID NO: 281552
  misc_feature: GYAE6OF01CJC0I.1.24.C02.1.454.CMB.1.raw
  modified_base (154)..(154): a, c, t, g, unknown or other
  misc_feature (154)..(154): n is a, c, g, or t

SEQ ID NO: 281831 - DNA, 154 bp, Homo sapiens; identical to SEQ ID NO: 281552
  misc_feature: GYAE6OF01A36EN.1.24.C02.1.454.CMB.1.raw
  modified_base (154)..(154): a, c, t, g, unknown or other
  misc_feature (154)..(154): n is a, c, g, or t

SEQ ID NO: 281832 - DNA, 166 bp, Homo sapiens
  misc_feature: GYAE6OF01ETS99.1.24.C02.1.454.CMB.1.raw
  modified_base (154)..(166): a, c, t, g, unknown or other
  misc_feature (154)..(166): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnnnn

SEQ ID NO: 281833 - DNA, 185 bp, Homo sapiens
  misc_feature: GYAE6OF01DYI46.1.24.C02.1.454.CMB.1.raw
  modified_base (157)..(185): a, c, t, g, unknown or other
  misc_feature (157)..(185): n is a, c, g, or t
tcagacgagtgcgtcacgaccggtgctcgatttagtacagatcgttagggaaagggaccaaggtggagatcaaacgaactgtggcctgcaccatctgtcttcatcttcccgccatctgaacgctactcgtctggagcgggctggcaaggcgcatagnnnnnnnnnnnnnnnnnnnnnnnnnnnnn

SEQ ID NO: 281834 - DNA, 154 bp, Homo sapiens; identical to SEQ ID NO: 281552
  misc_feature: GYAE6OF01CV6EG.1.24.C02.1.454.CMB.1.raw
  modified_base (154)..(154): a, c, t, g, unknown or other
  misc_feature (154)..(154): n is a, c, g, or t

SEQ ID NO: 281835 - DNA, 159 bp, Homo sapiens
  misc_feature: GYAE6OF01D6AZY.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnn

SEQ ID NO: 281836 - DNA, 224 bp, Homo sapiens
  misc_feature: GYAE6OF01CFGIY.1.24.C02.1.454.CMB.1.raw
  modified_base (165)..(224): a, c, t, g, unknown or other
  misc_feature (165)..(224): n is a, c, g, or t
tcagacgagtgcgtcacgaccggtgctcgatttagtacagatcgttagggtcgaagggaccaagggtggagggatcaaacgaactgtggctgcaccatctgtcttctatcttcccgcatctgaatagcggtactctggagccgggctgggcaagggcgcgatagnnnnnnnnnnnnnnnnnnnnnnnnnnnnnnnnnnnnnnnnnnnnnnnnnnnnnnnnnnnn

SEQ ID NO: 281837 - DNA, 169 bp, Homo sapiens
  misc_feature: GYAE6OF01EPRHY.1.24.C02.1.454.CMB.1.raw
  modified_base (155)..(169): a, c, t, g, unknown or other
  misc_feature (155)..(169): n is a, c, g, or t
tcagacgagtgcgtcacgaccggtgctcgatttagtacagatcgttagggcaaggggaccaaggtggagatcaaacgaactgtggctgcaccatctgtcttcatcttcccgccatctgaatagcgtactctgagcgggctggcaaggcgcatagnnnnnnnnnnnnnnn

SEQ ID NO: 281838 - DNA, 155 bp, Homo sapiens; identical to SEQ ID NO: 281575
  misc_feature: GYAE6OF01AOPUK.1.24.C02.1.454.CMB.1.raw
  modified_base (154)..(155): a, c, t, g, unknown or other
  misc_feature (154)..(155): n is a, c, g, or t

SEQ ID NO: 281839 - DNA, 155 bp, Homo sapiens; identical to SEQ ID NO: 281799
  misc_feature: GYAE6OF01CIBBQ.1.24.C02.1.454.CMB.1.raw
  modified_base (154)..(155): a, c, t, g, unknown or other
  misc_feature (154)..(155): n is a, c, g, or t

SEQ ID NO: 281840 - DNA, 155 bp, Homo sapiens; identical to SEQ ID NO: 281555
  misc_feature: GYAE6OF01EEIEX.1.24.C02.1.454.CMB.1.raw
  modified_base (154)..(155): a, c, t, g, unknown or other
  misc_feature (154)..(155): n is a, c, g, or t

SEQ ID NO: 281841 - DNA, 154 bp, Homo sapiens; identical to SEQ ID NO: 281552
  misc_feature: GYAE6OF01ERYMW.1.24.C02.1.454.CMB.1.raw
  modified_base (154)..(154): a, c, t, g, unknown or other
  misc_feature (154)..(154): n is a, c, g, or t

SEQ ID NO: 281842 - DNA, 155 bp, Homo sapiens; identical to SEQ ID NO: 281675
  misc_feature: GYAE6OF01ASKX0.1.24.C02.1.454.CMB.1.raw
  modified_base (154)..(155): a, c, t, g, unknown or other
  misc_feature (154)..(155): n is a, c, g, or t

SEQ ID NO: 281843 - DNA, 154 bp, Homo sapiens; identical to SEQ ID NO: 281552
  misc_feature: GYAE6OF01EAH54.1.24.C02.1.454.CMB.1.raw
  modified_base (154)..(154): a, c, t, g, unknown or other
  misc_feature (154)..(154): n is a, c, g, or t

SEQ ID NO: 281844 - DNA, 155 bp, Homo sapiens; identical to SEQ ID NO: 281555
  misc_feature: GYAE6OF01ERV3O.1.24.C02.1.454.CMB.1.raw
  modified_base (154)..(155): a, c, t, g, unknown or other
  misc_feature (154)..(155): n is a, c, g, or t

SEQ ID NO: 281845 - DNA, 154 bp, Homo sapiens
  misc_feature: GYAE6OF01CH3FT.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgtagcgtgctgagcgggctggcaaggcgcatagn

SEQ ID NO: 281846 - DNA, 180 bp, Homo sapiens
  misc_feature: GYAE6OF01ED518.1.24.C02.1.454.CMB.1.raw
  modified_base (155)..(180): a, c, t, g, unknown or other
  misc_feature (155)..(180): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtacgcactctgagcgggctggcaaggcgcatagnnnnnnnnnnnnnnnnnnnnnnnnnn

SEQ ID NO: 281847 - DNA, 163 bp, Homo sapiens
  misc_feature: GYAE6OF01A5UPM.1.24.C02.1.454.CMB.1.raw
  modified_base (153)..(163): a, c, t, g, unknown or other
  misc_feature (153)..(163): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagctactctgagcgggctggcaaggcgcatagnnnnnnnnnnn

SEQ ID NO: 281848 - DNA, 178 bp, Homo sapiens
  misc_feature: GYAE6OF01BQG4J.1.24.C02.1.454.CMB.1.raw
  modified_base (154)..(178): a, c, t, g, unknown or other
  misc_feature (154)..(178): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnnnnnnnnnnnnnnnn

SEQ ID NO: 281849 - DNA, 154 bp, Homo sapiens; identical to SEQ ID NO: 281552
  misc_feature: GYAE6OF01DC7TA.1.24.C02.1.454.CMB.1.raw
  modified_base (154)..(154): a, c, t, g, unknown or other
  misc_feature (154)..(154): n is a, c, g, or t

SEQ ID NO: 281850 - DNA, 154 bp, Homo sapiens; identical to SEQ ID NO: 281572
  misc_feature: GYAE6OF01DC1P8.1.24.C02.1.454.CMB.1.raw
  modified_base (154)..(154): a, c, t, g, unknown or other
  misc_feature (154)..(154): n is a, c, g, or t

SEQ ID NO: 281851 - DNA, 154 bp, Homo sapiens; identical to SEQ ID NO: 281607
  misc_feature: GYAE6OF01C0UTD.1.24.C02.1.454.CMB.1.raw
  modified_base (154)..(154): a, c, t, g, unknown or other
  misc_feature (154)..(154): n is a, c, g, or t

SEQ ID NO: 281852 - DNA, 154 bp, Homo sapiens; identical to SEQ ID NO: 281552
  misc_feature: GYAE6OF01B2XIE.1.24.C02.1.454.CMB.1.raw
  modified_base (154)..(154): a, c, t, g, unknown or other
  misc_feature (154)..(154): n is a, c, g, or t

SEQ ID NO: 281853 - DNA, 165 bp, Homo sapiens
  misc_feature: GYAE6OF01AVQ4F.1.24.C02.1.454.CMB.1.raw
  modified_base (155)..(165): a, c, t, g, unknown or other
  misc_feature (155)..(165): n is a, c, g, or t
tcagacgagtgcgtcacgaccggtgctcgatttagtacagatcgttagggcaagggaccaaggtggagatcaaacgtaactgtggctgcaccatctgtcttcatcttccgccatctgaatagcgtactctgagcgggctggtcaaggcgcatagnnnnnnnnnnn

SEQ ID NO: 281854 - DNA, 154 bp, Homo sapiens; identical to SEQ ID NO: 281552
  misc_feature: GYAE6OF01CWYVG.1.24.C02.1.454.CMB.1.raw
  modified_base (154)..(154): a, c, t, g, unknown or other
  misc_feature (154)..(154): n is a, c, g, or t

SEQ ID NO: 281855 - DNA, 154 bp, Homo sapiens; identical to SEQ ID NO: 281552
  misc_feature: GYAE6OF01A0A06.1.24.C02.1.454.CMB.1.raw
  modified_base (154)..(154): a, c, t, g, unknown or other
  misc_feature (154)..(154): n is a, c, g, or t

SEQ ID NO: 281856 - DNA, 174 bp, Homo sapiens
  misc_feature: GYAE6OF01BDGHS.1.24.C02.1.454.CMB.1.raw
  modified_base (152)..(174): a, c, t, g, unknown or other
  misc_feature (152)..(174): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatcgtagcactctgagcgggctggcaaggcgcatgnnnnnnnnnnnnnnnnnnnnnnn

SEQ ID NO: 281857 - DNA, 168 bp, Homo sapiens
  misc_feature: GYAE6OF01AOQH6.1.24.C02.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacagatcgttagggaaagggaacaagggtggagatcaaacgaactgtggctgcaccatctgtcttcatcttcccgccatctgaacgtctactgctgagcgggctggcaaggcgcatagnnnnnnnnnnnnnn

SEQ ID NO: 281858 - DNA, 160 bp, Homo sapiens
  misc_feature: GYAE6OF01DDQ59.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgaacgcaccgtctgagcgggctggcaaggcgcatagnnnnnnn

SEQ ID NO: 281859 - DNA, 155 bp, Homo sapiens; identical to SEQ ID NO: 281753
  misc_feature: GYAE6OF01ACYPR.1.24.C02.1.454.CMB.1.raw
  modified_base (154)..(155): a, c, t, g, unknown or other
  misc_feature (154)..(155): n is a, c, g, or t

SEQ ID NO: 281860 - DNA, 207 bp, Homo sapiens
  misc_feature: GYAE6OF01C1MOI.1.24.C02.1.454.CMB.1.raw
  modified_base (162)..(207): a, c, t, g, unknown or other
  misc_feature (162)..(207): n is a, c, g, or t
tcagacgagtgcgtcacgaccggtgctcgatttagtacagatcgttagggtcgtaaggggaccaaaggtggagatcaaacgaactgtggctgcaccatctgtcttcatcttcccgccatcctgaatagcgtactctgagcgggctggcaaggcgctatagcnnnnnnnnnnnnnnnnnnnnnnnnnnnnnnnnnnnnnnnnnnnnnn

SEQ ID NO: 281861 - DNA, 154 bp, Homo sapiens; identical to SEQ ID NO: 281552
  misc_feature: GYAE6OF01EJGFU.1.24.C02.1.454.CMB.1.raw
  modified_base (154)..(154): a, c, t, g, unknown or other
  misc_feature (154)..(154): n is a, c, g, or t

SEQ ID NO: 281862 - DNA, 218 bp, Homo sapiens
  misc_feature: GYAE6OF01AKGO0.1.24.C02.1.454.CMB.1.raw
  modified_base (161)..(162): a, c, t, g, unknown or other
  misc_feature (161)..(162): n is a, c, g, or t
  modified_base (164)..(218): a, c, t, g, unknown or other
  misc_feature (164)..(218): n is a, c, g, or t
tcagacgagtgcgtcacgaccggtgctcgatttagtacagatcgttagggcaagggggaccaaggtggagatcaaacgaactgtggctgaaccatcctgtcttcatcgttcccgccatctgaatagcgtactctgagcgggctggcaagggcgcgactagnncnnnnnnnnnnnnnnnnnnnnnnnnnnnnnnnnnnnnnnnnnnnnnnnnnnnnnnn

SEQ ID NO: 281863 - DNA, 154 bp, Homo sapiens; identical to SEQ ID NO: 281576
  misc_feature: GYAE6OF01B0XNN.1.24.C02.1.454.CMB.1.raw
  modified_base (154)..(154): a, c, t, g, unknown or other
  misc_feature (154)..(154): n is a, c, g, or t

SEQ ID NO: 281864 - DNA, 154 bp, Homo sapiens; identical to SEQ ID NO: 281604
  misc_feature: GYAE6OF01A4HD4.1.24.C02.1.454.CMB.1.raw
  modified_base (154)..(154): a, c, t, g, unknown or other
  misc_feature (154)..(154): n is a, c, g, or t

SEQ ID NO: 281865 - DNA, 155 bp, Homo sapiens
  misc_feature: GYAE6OF01AW8AU.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgtatactctgagcgggctggcaaggcgcatagnn

SEQ ID NO: 281866 - DNA, 154 bp, Homo sapiens; identical to SEQ ID NO: 281681
  misc_feature: GYAE6OF01BOY4I.1.24.C02.1.454.CMB.1.raw
  modified_base (154)..(154): a, c, t, g, unknown or other
  misc_feature (154)..(154): n is a, c, g, or t

SEQ ID NO: 281867 - DNA, 177 bp, Homo sapiens
  misc_feature: GYAE6OF01DBS9W.1.24.C02.1.454.CMB.1.raw
  modified_base (156)..(177): a, c, t, g, unknown or other
  misc_feature (156)..(177): n is a, c, g, or t
tcagacgagtgcgtcacgaccggtgctcgatttagtacagatcgttagggaaagggaccaaggtggagatcaaacgaactggtggctgcaccatctgtcttcatcttcccgccatcctgatatgtatactctgagcgggctggcaaggcgcatagnnnnnnnnnnnnnnnnnnnnnn

SEQ ID NO: 281868 - DNA, 168 bp, Homo sapiens
  misc_feature: GYAE6OF01BMA9J.1.24.C02.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacagatcgttagggaaagggaccaaaggtggagatcaaacgaactgtggctgcaccatctgtcttcatcttcccgccatctgaatagcgtactctgagcgggctggcaaggcgcatagnnnnnnnnnnnnnn

SEQ ID NO: 281869 - DNA, 154 bp, Homo sapiens; identical to SEQ ID NO: 281572
  misc_feature: GYAE6OF01CAW6B.1.24.C02.1.454.CMB.1.raw
  modified_base (154)..(154): a, c, t, g, unknown or other
  misc_feature (154)..(154): n is a, c, g, or t

SEQ ID NO: 281870 - DNA, 154 bp, Homo sapiens; identical to SEQ ID NO: 281706
  misc_feature: GYAE6OF01AWQPH.1.24.C02.1.454.CMB.1.raw
  modified_base (154)..(154): a, c, t, g, unknown or other
  misc_feature (154)..(154): n is a, c, g, or t

SEQ ID NO: 281871 - DNA, 155 bp, Homo sapiens; identical to SEQ ID NO: 281825
  misc_feature: GYAE6OF01BJ3AS.1.24.C02.1.454.CMB.1.raw
  modified_base (154)..(155): a, c, t, g, unknown or other
  misc_feature (154)..(155): n is a, c, g, or t

SEQ ID NO: 281872 - DNA, 156 bp, Homo sapiens
  misc_feature: GYAE6OF01D6BJQ.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtctactgctgagcgggctggcaaggcgcatagnnn

SEQ ID NO: 281873 - DNA, 174 bp, Homo sapiens
  misc_feature: GYAE6OF01EQEFC.1.24.C02.1.454.CMB.1.raw
  modified_base (156)..(174): a, c, t, g, unknown or other
  misc_feature (156)..(174): n is a, c, g, or t
tcagacgagtgcgtcacgaccggtgctcgatttagtacagatcgttagggaaagggaccaaggtggaaatcaaacgaactgtggctgcaccatctgtcttcatcttcccaccctcctcacgcactcgtctgagcgggtctggcaaggcgtcatagnnnnnnnnnnnnnnnnnnn

SEQ ID NO: 281874 - DNA, 154 bp, Homo sapiens; identical to SEQ ID NO: 281609
  misc_feature: GYAE6OF01EQAYH.1.24.C02.1.454.CMB.1.raw
  modified_base (154)..(154): a, c, t, g, unknown or other
  misc_feature (154)..(154): n is a, c, g, or t

SEQ ID NO: 281875 - DNA, 154 bp, Homo sapiens; identical to SEQ ID NO: 281552
  misc_feature: GYAE6OF01DWZQK.1.24.C02.1.454.CMB.1.raw
  modified_base (154)..(154): a, c, t, g, unknown or other
  misc_feature (154)..(154): n is a, c, g, or t

SEQ ID NO: 281876 - DNA, 155 bp, Homo sapiens
  misc_feature: GYAE6OF01DLLMD.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtctactgctgagcgggctggcaaggcgcatagnn

SEQ ID NO: 281877 - DNA, 155 bp, Homo sapiens; identical to SEQ ID NO: 281575
  misc_feature: GYAE6OF01CCMWM.1.24.C02.1.454.CMB.1.raw
  modified_base (154)..(155): a, c, t, g, unknown or other
  misc_feature (154)..(155): n is a, c, g, or t

SEQ ID NO: 281878 - DNA, 157 bp, Homo sapiens; identical to SEQ ID NO: 281599
  misc_feature: GYAE6OF01BF58M.1.24.C02.1.454.CMB.1.raw
  modified_base (154)..(157): a, c, t, g, unknown or other
  misc_feature (154)..(157): n is a, c, g, or t

SEQ ID NO: 281879 - DNA, 154 bp, Homo sapiens; identical to SEQ ID NO: 281572
  misc_feature: GYAE6OF01DHAA1.1.24.C02.1.454.CMB.1.raw
  modified_base (154)..(154): a, c, t, g, unknown or other
  misc_feature (154)..(154): n is a, c, g, or t

SEQ ID NO: 281880 - DNA, 154 bp, Homo sapiens; identical to SEQ ID NO: 281604
  misc_feature: GYAE6OF01BDSOI.1.24.C02.1.454.CMB.1.raw
  modified_base (154)..(154): a, c, t, g, unknown or other
  misc_feature (154)..(154): n is a, c, g, or t

SEQ ID NO: 281881 - DNA, 154 bp, Homo sapiens; identical to SEQ ID NO: 281552
  misc_feature: GYAE6OF01CCZIM.1.24.C02.1.454.CMB.1.raw
  modified_base (154)..(154): a, c, t, g, unknown or other
  misc_feature (154)..(154): n is a, c, g, or t

SEQ ID NO: 281882 - DNA, 181 bp, Homo sapiens
  misc_feature: GYAE6OF01EB2ZS.1.24.C02.1.454.CMB.1.raw
  modified_base (157)..(181): a, c, t, g, unknown or other
  misc_feature (157)..(181): n is a, c, g, or t
tcagacgagtgcgtcacgaccggtgctcgatttagtacagatcgttagggcaagggaccgaaggtggagatcaaacgaactgtggctgcaccatctgtcttcatcttcccgccatcctgaatacgcgtactctgagcgggctggcaaggcgcatagnnnnnnnnnnnnnnnnnnnnnnnnn

SEQ ID NO: 281883 - DNA, 156 bp, Homo sapiens; identical to SEQ ID NO: 281566
  misc_feature: GYAE6OF01COF5C.1.24.C02.1.454.CMB.1.raw
  modified_base (154)..(156): a, c, t, g, unknown or other
  misc_feature (154)..(156): n is a, c, g, or t

SEQ ID NO: 281884 - DNA, 154 bp, Homo sapiens; identical to SEQ ID NO: 281552
  misc_feature: GYAE6OF01AQT4O.1.24.C02.1.454.CMB.1.raw
  modified_base (154)..(154): a, c, t, g, unknown or other
  misc_feature (154)..(154): n is a, c, g, or t

SEQ ID NO: 281885 - DNA, 157 bp, Homo sapiens; identical to SEQ ID NO: 281599
  misc_feature: GYAE6OF01BED6F.1.24.C02.1.454.CMB.1.raw
  modified_base (154)..(157): a, c, t, g, unknown or other
  misc_feature (154)..(157): n is a, c, g, or t

SEQ ID NO: 281886 - DNA, 154 bp, Homo sapiens; identical to SEQ ID NO: 281552
  misc_feature: GYAE6OF01ET2SP.1.24.C02.1.454.CMB.1.raw
  modified_base (154)..(154): a, c, t, g, unknown or other
  misc_feature (154)..(154): n is a, c, g, or t

SEQ ID NO: 281887 - DNA, 154 bp, Homo sapiens; identical to SEQ ID NO: 281644
  misc_feature: GYAE6OF01C04A5.1.24.C02.1.454.CMB.1.raw
  modified_base (154)..(154): a, c, t, g, unknown or other
  misc_feature (154)..(154): n is a, c, g, or t

SEQ ID NO: 281888 - DNA, 156 bp, Homo sapiens
  misc_feature: GYAE6OF01DPNKJ.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnn

SEQ ID NO: 281889 - DNA, 176 bp, Homo sapiens
  misc_feature: GYAE6OF01BZFLL.1.24.C02.1.454.CMB.1.raw
  modified_base (133)..(133): a, c, t, g, unknown or other
  misc_feature (133)..(133): n is a, c, g, or t
  modified_base (152)..(152): a, c, t, g, unknown or other
  misc_feature (152)..(152): n is a, c, g, or t
  modified_base (158)..(176): a, c, t, g, unknown or other
  misc_feature (158)..(176): n is a, c, g, or t
tcagacgagtgcgtcacgaccggtgctcgatttagtacagatcgtttagggtcgaagggaccaaggtggagatcaaacgaactgtggctgctaccatctggtcttcatccttccgccatctgaatgcgtactntgagcgggctggcaaggcncatagnnnnnnnnnnnnnnnnnnn

SEQ ID NO: 281890 - DNA, 220 bp, Homo sapiens
  misc_feature: GYAE6OF01BEAT7.1.24.C02.1.454.CMB.1.raw
  modified_base (151)..(220): a, c, t, g, unknown or other
  misc_feature (151)..(220): n is a, c, g, or t
tcagacgagtgcgtcacgaccggtgctcgatttagtacagatcgttagggcaagggaccaaggtgtagatcaaacgaactgtggctgcaccatctgtcttcatcttccgcatctgaatagcgtactctgagcggctggcaaggcgcatagnnnnnnnnnnnnnnnnnnnnnnnnnnnnnnnnnnnnnnnnnnnnnnnnnnnnnnnnnnnnnnnnnnnnnn

SEQ ID NO: 281891 - DNA, 160 bp, Homo sapiens
  misc_feature: GYAE6OF01CZHV6.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgtatactctgagcgggctggcaaggcgcatagnnnnnnn

SEQ ID NO: 281892 - DNA, 155 bp, Homo sapiens
  misc_feature: GYAE6OF01C947F.1.24.C02.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgcactcgtctgagcgggctggcaaaggcgcatagn

SEQ ID NO: 281893 - DNA, 154 bp, Homo sapiens; identical to SEQ ID NO: 281576
  misc_feature: GYAE6OF01D1L88.1.24.C02.1.454.CMB.1.raw
  modified_base (154)..(154): a, c, t, g, unknown or other
  misc_feature (154)..(154): n is a, c, g, or t

SEQ ID NO: 281894 - DNA, 174 bp, Homo sapiens
  misc_feature: GYAE6OF01CEDSY.1.24.C02.1.454.CMB.1.raw
  modified_base (155)..(174): a, c, t, g, unknown or other
  misc_feature (155)..(174): n is a, c, g, or t
tcagacgagtgcgtcacgaccggtgctcgatttagtacagatcgttagggaaagtgaccgaaggtggagatcaaactaactgtggctggcaccatctgtcttcatcttccgccatctgatcgtactgcgctgagcgggctggcaaggcgcatagnnnnnnnnnnnnnnnnnnnn

SEQ ID NO: 281895 - DNA, 154 bp, Homo sapiens; identical to SEQ ID NO: 281604
  misc_feature: GYAE6OF01DAP1G.1.24.C02.1.454.CMB.1.raw
  modified_base (154)..(154): a, c, t, g, unknown or other
  misc_feature (154)..(154): n is a, c, g, or t

SEQ ID NO: 281896 - DNA, 154 bp, Homo sapiens; identical to SEQ ID NO: 281569
  misc_feature: GYAE6OF01EG1O8.1.24.C02.1.454.CMB.1.raw
  modified_base (154)..(154): a, c, t, g, unknown or other
  misc_feature (154)..(154): n is a, c, g, or t

SEQ ID NO: 281897 - DNA, 154 bp, Homo sapiens; identical to SEQ ID NO: 281569
  misc_feature: GYAE6OF01BXBKH.1.24.C02.1.454.CMB.1.raw
  modified_base (154)..(154): a, c, t, g, unknown or other
  misc_feature (154)..(154): n is a, c, g, or t

SEQ ID NO: 281898 - DNA, 156 bp, Homo sapiens; identical to SEQ ID NO: 281661
  misc_feature: GYAE6OF01BW1PA.1.24.C02.1.454.CMB.1.raw
  modified_base (154)..(156): a, c, t, g, unknown or other
  misc_feature (154)..(156): n is a, c, g, or t

SEQ ID NO: 281899 - DNA, 162 bp, Homo sapiens
  misc_feature: GYAE6OF01BYQVS.1.24.C02.1.454.CMB.1.raw
  modified_base (155)..(162): a, c, t, g, unknown or other
  misc_feature (155)..(162): n is a, c, g, or t
tcagacgagtgcgtcacgaccggtgctcgatttagtacagatcgttagggaaagtgaccaaggtggaagatcaaactaactgtggctgcaccatctgtcttcatcttcccgccatctgatcgtactgcgctgagcgggctggcaaggcgcatagnnnnnnnn

SEQ ID NO: 281900 - DNA, 155 bp, Homo sapiens
  misc_feature: GYAE6OF01BJQHR.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccgaaggtggagatcaaacgaactgtggctgcaccatctgtcttcatcttcccgccatctgaatgcgtactctgagcgggctggcaaggcgcatagnn

SEQ ID NO: 281901 - DNA, 154 bp, Homo sapiens; identical to SEQ ID NO: 281619
  misc_feature: GYAE6OF01CUM6P.1.24.C02.1.454.CMB.1.raw
  modified_base (153)..(154): a, c, t, g, unknown or other
  misc_feature (153)..(154): n is a, c, g, or t

SEQ ID NO: 281902 - DNA, 154 bp, Homo sapiens; identical to SEQ ID NO: 281607
  misc_feature: GYAE6OF01ALCCT.1.24.C02.1.454.CMB.1.raw
  modified_base (154)..(154): a, c, t, g, unknown or other
  misc_feature (154)..(154): n is a, c, g, or t

SEQ ID NO: 281903 - DNA, 180 bp, Homo sapiens
  misc_feature: GYAE6OF01CSV6O.1.24.C02.1.454.CMB.1.raw
  modified_base (157)..(180): a, c, t, g, unknown or other
  misc_feature (157)..(180): n is a, c, g, or t
tcagacgagtgcgtcacgaccggtgctcgatttagtacagatcgttagggaaaggggaccgaaggtggagagtcaaacgaactgtggctgcaccatctgtcttcatcttcccgccatctgaacgcactcgtctgagcgggctggcaaggcgcatagnnnnnnnnnnnnnnnnnnnnnnnn

SEQ ID NO: 281904 - DNA, 154 bp, Homo sapiens
  misc_feature: GYAE6OF01D7CB5.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaatgtggagatcaaacgaactgtggctgcaccatctgtcttcatcttcccgccatctgagagtgcgtctctgagcgggctggcaaggcgcatagn

SEQ ID NO: 281905 - DNA, 173 bp, Homo sapiens
  misc_feature: GYAE6OF01DC7U8.1.24.C02.1.454.CMB.1.raw
  modified_base (155)..(173): a, c, t, g, unknown or other
  misc_feature (155)..(173): n is a, c, g, or t
tcagacgagtgcgtcacgaccggtgctcgatttagtacagatcgttagggaaagggaccaaggtggagatcaaacgaactgtggctgcaccatcctgtcttcatcttcccgccatctgaacgcactgtctgagcgggctggcaaggcgcattagnnnnnnnnnnnnnnnnnnn

SEQ ID NO: 281906 - DNA, 155 bp, Homo sapiens; identical to SEQ ID NO: 281555
  misc_feature: GYAE6OF01ALBTK.1.24.C02.1.454.CMB.1.raw
  modified_base (154)..(155): a, c, t, g, unknown or other
  misc_feature (154)..(155): n is a, c, g, or t

SEQ ID NO: 281907 - DNA, 155 bp, Homo sapiens
  misc_feature: GYAE6OF01DFK2O.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaatgtggagatcaaacgaactgtggctgcaccatctgtcttcatcttcccgccatctgagagtgcgtctctgagcgggctggcaaggcgcatagnn

SEQ ID NO: 281908 - DNA, 156 bp, Homo sapiens; identical to SEQ ID NO: 281595
  misc_feature: GYAE6OF01BDM4Z.1.24.C02.1.454.CMB.1.raw
  modified_base (154)..(156): a, c, t, g, unknown or other
  misc_feature (154)..(156): n is a, c, g, or t

SEQ ID NO: 281909 - DNA, 155 bp, Homo sapiens; identical to SEQ ID NO: 281693
  misc_feature: GYAE6OF01D1UNW.1.24.C02.1.454.CMB.1.raw
  modified_base (154)..(155): a, c, t, g, unknown or other
  misc_feature (154)..(155): n is a, c, g, or t

SEQ ID NO: 281910 - DNA, 154 bp, Homo sapiens; identical to SEQ ID NO: 281572
  misc_feature: GYAE6OF01BSK1K.1.24.C02.1.454.CMB.1.raw
  modified_base (154)..(154): a, c, t, g, unknown or other
  misc_feature (154)..(154): n is a, c, g, or t

SEQ ID NO: 281911 - DNA, 155 bp, Homo sapiens; identical to SEQ ID NO: 281555
  misc_feature: GYAE6OF01DFNK5.1.24.C02.1.454.CMB.1.raw
  modified_base (154)..(155): a, c, t, g, unknown or other
  misc_feature (154)..(155): n is a, c, g, or t

SEQ ID NO: 281912 - DNA, 155 bp, Homo sapiens; identical to SEQ ID NO: 281753
  misc_feature: GYAE6OF01A88V5.1.24.C02.1.454.CMB.1.raw
  modified_base (154)..(155): a, c, t, g, unknown or other
  misc_feature (154)..(155): n is a, c, g, or t

SEQ ID NO: 281913 - DNA, 162 bp, Homo sapiens
  misc_feature: GYAE6OF01DG4I4.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcggctggcaaggcgcatagnnnnnnnnn

SEQ ID NO: 281914 - DNA, 168 bp, Homo sapiens
  misc_feature: GYAE6OF01B6P9R.1.24.C02.1.454.CMB.1.raw
  modified_base (153)..(168): a, c, t, g, unknown or other
  misc_feature (153)..(168): n is a, c, g, or t
tcagacgagtgcgtcacgaccggtgctcgatttagtacagatcgttagggaaagtgaccaaggtggagatcaaactaactgtggctgcaccatctgtcttcatcttcccgcatctgatcgtactgcgctgagcgggctggcaaggcgcatagnnnnnnnnnnnnnnnn

SEQ ID NO: 281915 - DNA, 154 bp, Homo sapiens; identical to SEQ ID NO: 281572
  misc_feature: GYAE6OF01D93MI.1.24.C02.1.454.CMB.1.raw
  modified_base (154)..(154): a, c, t, g, unknown or other
  misc_feature (154)..(154): n is a, c, g, or t

SEQ ID NO: 281916 - DNA, 154 bp, Homo sapiens
  misc_feature: GYAE6OF01COTBU.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggttgcaccatctgtcttcatcttcccgccatctgatctctcgactctgagcgggctggcaaggcgcatagn

SEQ ID NO: 281917 - DNA, 159 bp, Homo sapiens
  misc_feature: GYAE6OF01CO73V.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggcaagggaccaaggtggagatcaaacgaactgtggctgcaccatctgtattcatcttcccgccatctgaatagcgtactctgagcgggctggcaaggcgcatagnnnnnn

SEQ ID NO: 281918 - DNA, 157 bp, Homo sapiens; identical to SEQ ID NO: 281599
  misc_feature: GYAE6OF01C3EAI.1.24.C02.1.454.CMB.1.raw
  modified_base (154)..(157): a, c, t, g, unknown or other
  misc_feature (154)..(157): n is a, c, g, or t

SEQ ID NO: 281919 - DNA, 152 bp, Homo sapiens
  misc_feature: GYAE6OF01EMCPF.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaaggaccaaggtggagatcaaacgaactgtggctgcaccatctgtcttcatcttcccgccatctgatatacgatcgctgagcgggctggcaaggcgcatagn

SEQ ID NO: 281920 - DNA, 154 bp, Homo sapiens; identical to SEQ ID NO: 281552
  misc_feature: GYAE6OF01D0EQ5.1.24.C02.1.454.CMB.1.raw
  modified_base (154)..(154): a, c, t, g, unknown or other
  misc_feature (154)..(154): n is a, c, g, or t

SEQ ID NO: 281921 - DNA, 155 bp, Homo sapiens; identical to SEQ ID NO: 281555
  misc_feature: GYAE6OF01A1WIM.1.24.C02.1.454.CMB.1.raw
  modified_base (154)..(155): a, c, t, g, unknown or other
  misc_feature (154)..(155): n is a, c, g, or t

SEQ ID NO: 281922 - DNA, 154 bp, Homo sapiens; identical to SEQ ID NO: 281552
  misc_feature: GYAE6OF01CDEWG.1.24.C02.1.454.CMB.1.raw
  modified_base (154)..(154): a, c, t, g, unknown or other
  misc_feature (154)..(154): n is a, c, g, or t

SEQ ID NO: 281923 - DNA, 154 bp, Homo sapiens; identical to SEQ ID NO: 281552
  misc_feature: GYAE6OF01EPNPO.1.24.C02.1.454.CMB.1.raw
  modified_base (154)..(154): a, c, t, g, unknown or other
  misc_feature (154)..(154): n is a, c, g, or t

SEQ ID NO: 281924 - DNA, 173 bp, Homo sapiens
  misc_feature: GYAE6OF01DSEXV.1.24.C02.1.454.CMB.1.raw
  modified_base (155)..(173): a, c, t, g, unknown or other
  misc_feature (155)..(173): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgtatactctgagcgggctggcaaggtcgcatagnnnnnnnnnnnnnnnnnnn

SEQ ID NO: 281925 - DNA, 153 bp, Homo sapiens
  misc_feature: GYAE6OF01CV1JA.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtacctgagcgggctggcaaggcgcatagn

SEQ ID NO: 281926 - DNA, 154 bp, Homo sapiens; identical to SEQ ID NO: 281572
  misc_feature: GYAE6OF01CCVKC.1.24.C02.1.454.CMB.1.raw
  modified_base (154)..(154): a, c, t, g, unknown or other
  misc_feature (154)..(154): n is a, c, g, or t

SEQ ID NO: 281927 - DNA, 154 bp, Homo sapiens; identical to SEQ ID NO: 281552
  misc_feature: GYAE6OF01EDS3Q.1.24.C02.1.454.CMB.1.raw
  modified_base (154)..(154): a, c, t, g, unknown or other
  misc_feature (154)..(154): n is a, c, g, or t

SEQ ID NO: 281928 - DNA, 155 bp, Homo sapiens; identical to SEQ ID NO: 281693
  misc_feature: GYAE6OF01BXA2Z.1.24.C02.1.454.CMB.1.raw
  modified_base (154)..(155): a, c, t, g, unknown or other
  misc_feature (154)..(155): n is a, c, g, or t

SEQ ID NO: 281929 - DNA, 160 bp, Homo sapiens
  misc_feature: GYAE6OF01EMBQK.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgcatagnnnnnnn

SEQ ID NO: 281930 - DNA, 189 bp, Homo sapiens
  misc_feature: GYAE6OF01C4540.1.24.C02.1.454.CMB.1.raw
  modified_base (159)..(189): a, c, t, g, unknown or other
  misc_feature (159)..(189): n is a, c, g, or t
tcagacgagtgcgtcacgaccggtgctcgatttagtacagatcgttagggctaaggggaccgaaggtggagatcaaacgaactgtggctgcaccatctgtcttcatcttcccgccactctgaatagcgtactctgagccgggctggcaaggcgcatagnnnnnnnnnnnnnnnnnnnnnnnnnnnnnnn

SEQ ID NO: 281931 - DNA, 155 bp, Homo sapiens
  misc_feature: GYAE6OF01DAD14.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnn

SEQ ID NO: 281932 - DNA, 168 bp, Homo sapiens
  misc_feature: GYAE6OF01E1COR.1.24.C02.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcattagnnnnnnnnnnnnnn

SEQ ID NO: 281933 - DNA, 155 bp, Homo sapiens; identical to SEQ ID NO: 281675
  misc_feature: GYAE6OF01BO9SN.1.24.C02.1.454.CMB.1.raw
  modified_base (154)..(155): a, c, t, g, unknown or other
  misc_feature (154)..(155): n is a, c, g, or t

SEQ ID NO: 281934 - DNA, 154 bp, Homo sapiens
  misc_feature: GYAE6OF01CM784.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaaagtgaccaaggtggagatcaaactaactgtggctgcaccatctgtcttcatcttcccgtcatctgatcgtactgcgctgagcggctggcaaggcgcatagnn

SEQ ID NO: 281935 - DNA, 155 bp, Homo sapiens; identical to SEQ ID NO: 281693
  misc_feature: GYAE6OF01EP9Y1.1.24.C02.1.454.CMB.1.raw
  modified_base (154)..(155): a, c, t, g, unknown or other
  misc_feature (154)..(155): n is a, c, g, or t

SEQ ID NO: 281936 - DNA, 156 bp, Homo sapiens
  misc_feature: GYAE6OF01CUDLH.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaagctgcaaatcaaacgaactgtggctgcaccatctgtcttcatcttcccgccatctgaacgcactcgtctgagcgggctggcaaggcgcatagnnn

SEQ ID NO: 281937 - DNA, 156 bp, Homo sapiens; identical to SEQ ID NO: 281661
  misc_feature: GYAE6OF01BNAVT.1.24.C02.1.454.CMB.1.raw
  modified_base (154)..(156): a, c, t, g, unknown or other
  misc_feature (154)..(156): n is a, c, g, or t

SEQ ID NO: 281938 - DNA, 173 bp, Homo sapiens
  misc_feature: GYAE6OF01CBJSK.1.24.C02.1.454.CMB.1.raw
  modified_base (156)..(173): a, c, t, g, unknown or other
  misc_feature (156)..(173): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatactgctagtctgagtcgggctggcaaggcgtcatagnnnnnnnnnnnnnnnnnn

SEQ ID NO: 281939 - DNA, 153 bp, Homo sapiens; identical to SEQ ID NO: 281651
  misc_feature: GYAE6OF01DR6SK.1.24.C02.1.454.CMB.1.raw
  modified_base (153)..(153): a, c, t, g, unknown or other
  misc_feature (153)..(153): n is a, c, g, or t

SEQ ID NO: 281940 - DNA, 153 bp, Homo sapiens
  misc_feature: GYAE6OF01ANOTI.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctatatgtatactctgagcgggctggcaaggcgcatagn

SEQ ID NO: 281941 - DNA, 205 bp, Homo sapiens
  misc_feature: GYAE6OF01A39WS.1.24.C02.1.454.CMB.1.raw
  modified_base (156)..(205): a, c, t, g, unknown or other
  misc_feature (156)..(205): n is a, c, g, or t
tcagacgagtgcgtcacgaccggtgctcgatttagtacagatcgttagggcaagggaccaaggtggagatcaaacgaactggtggctgcaccatctgtcttcatcttcccgccatctgaatagcgtactctgagcgggctggcaaggcgcatacgnnnnnnnnnnnnnnnnnnnnnnnnnnnnnnnnnnnnnnnnnnnnnnnnnn

SEQ ID NO: 281942 - DNA, 154 bp, Homo sapiens; identical to SEQ ID NO: 281552
  misc_feature: GYAE6OF01C0A60.1.24.C02.1.454.CMB.1.raw
  modified_base (154)..(154): a, c, t, g, unknown or other
  misc_feature (154)..(154): n is a, c, g, or t

SEQ ID NO: 281943 - DNA, 153 bp, Homo sapiens
  misc_feature: GYAE6OF01CP9N8.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcggctggcaaggcgcatagnn

SEQ ID NO: 281944 - DNA, 154 bp, Homo sapiens; identical to SEQ ID NO: 281569
  misc_feature: GYAE6OF01DC1KR.1.24.C02.1.454.CMB.1.raw
  modified_base (154)..(154): a, c, t, g, unknown or other
  misc_feature (154)..(154): n is a, c, g, or t

SEQ ID NO: 281945 - DNA, 155 bp, Homo sapiens; identical to SEQ ID NO: 281555
  misc_feature: GYAE6OF01CXNEQ.1.24.C02.1.454.CMB.1.raw
  modified_base (154)..(155): a, c, t, g, unknown or other
  misc_feature (154)..(155): n is a, c, g, or t

SEQ ID NO: 281946 - DNA, 155 bp, Homo sapiens; identical to SEQ ID NO: 281555
  misc_feature: GYAE6OF01EMUZF.1.24.C02.1.454.CMB.1.raw
  modified_base (154)..(155): a, c, t, g, unknown or other
  misc_feature (154)..(155): n is a, c, g, or t

SEQ ID NO: 281947 - DNA, 163 bp, Homo sapiens
  misc_feature: GYAE6OF01C7VV5.1.24.C02.1.454.CMB.1.raw
  modified_base (154)..(163): a, c, t, g, unknown or other
  misc_feature (154)..(163): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcatagnnnnnnnnnn

SEQ ID NO: 281948 - DNA, 193 bp, Homo sapiens
  misc_feature: GYAE6OF01BP6GH.1.24.C02.1.454.CMB.1.raw
  modified_base (156)..(193): a, c, t, g, unknown or other
  misc_feature (156)..(193): n is a, c, g, or t
tcagacgagtgcgtcacgaccggtgctcgatttagtacagatcgttagggcgaacgggaccaaggtggacgatcaaacgaactgtggctgcaccatctgtcttcatcttccgccatctgaatagcgtactctgagcggtctggcaaggcgcatagnnnnnnnnnnnnnnnnnnnnnnnnnnnnnnnnnnnnnn

SEQ ID NO: 281949 - DNA, 179 bp, Homo sapiens
  misc_feature: GYAE6OF01CWOBQ.1.24.C02.1.454.CMB.1.raw
  modified_base (155)..(179): a, c, t, g, unknown or other
  misc_feature (155)..(179): n is a, c, g, or t
tcagacgagtgcgtcacgaccggtgctcgatttagtacagatcgttagggaaagggaccaaggtggagatcaaacgaactgtggctgcaccatctcgtcttcatcttcccgccatctgaacgcactcgtctgagcgggctggcaaggcgcatagnnnnnnnnnnnnnnnnnnnnnnnnn

SEQ ID NO: 281950 - DNA, 156 bp, Homo sapiens; identical to SEQ ID NO: 281888
  misc_feature: GYAE6OF01BZXXH.1.24.C02.1.454.CMB.1.raw
  modified_base (154)..(156): a, c, t, g, unknown or other
  misc_feature (154)..(156): n is a, c, g, or t

SEQ ID NO: 281951 - DNA, 155 bp, Homo sapiens
  misc_feature: GYAE6OF01E5JGV.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgcctcctctctctcgactctgagcgggctggcaaggcgcatagnnn

SEQ ID NO: 281952 - DNA, 155 bp, Homo sapiens; identical to SEQ ID NO: 281575
  misc_feature: GYAE6OF01DTZPA.1.24.C02.1.454.CMB.1.raw
  modified_base (154)..(155): a, c, t, g, unknown or other
  misc_feature (154)..(155): n is a, c, g, or t

SEQ ID NO: 281953 - DNA, 176 bp, Homo sapiens
  misc_feature: GYAE6OF01BJ228.1.24.C02.1.454.CMB.1.raw
  modified_base (155)..(176): a, c, t, g, unknown or other
  misc_feature (155)..(176): n is a, c, g, or t
tcagacgagtgcgtcacgaccggtgctcgatttagtacagatcgttagggcaagggaccaaggtggagatcaaacgaactgtggctgcaccagtcctgtcttcatcttcccgccatctgaatgcgtactctgagcgggctggcaaggcgcatagnnnnnnnnnnnnnnnnnnnnnn

SEQ ID NO: 281954 - DNA, 154 bp, Homo sapiens
  misc_feature: GYAE6OF01ANUQP.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaacaaggtgtagatcaaacgaactgtggctgcaccatctgtcttcatcttcccgccatctgaatagcgtactctgagcgggctggcaaggcgcatagn

SEQ ID NO: 281955 - DNA, 165 bp, Homo sapiens
  misc_feature: GYAE6OF01A4QWX.1.24.C02.1.454.CMB.1.raw
  modified_base (155)..(165): a, c, t, g, unknown or other
  misc_feature (155)..(165): n is a, c, g, or t
tcagacgagtgcgtcacgaccggtgctcgatttagtacagatcgttaagggcaagggaccaaggtggagatcaaacgaactgtggctgcaccatctgtcttcatcttcccgccatctgaatagcgtactctgagcgggctggcaaggcgcatagnnnnnnnnnnn

SEQ ID NO: 281956 - DNA, 154 bp, Homo sapiens; identical to SEQ ID NO: 281572
  misc_feature: GYAE6OF01DJOIW.1.24.C02.1.454.CMB.1.raw
  modified_base (154)..(154): a, c, t, g, unknown or other
  misc_feature (154)..(154): n is a, c, g, or t

SEQ ID NO: 281957 - DNA, 154 bp, Homo sapiens; identical to SEQ ID NO: 281904
  misc_feature: GYAE6OF01CO3DH.1.24.C02.1.454.CMB.1.raw
  modified_base (154)..(154): a, c, t, g, unknown or other
  misc_feature (154)..(154): n is a, c, g, or t

SEQ ID NO: 281958 - DNA, 158 bp, Homo sapiens
  misc_feature: GYAE6OF01EI0X4.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactcctgagcgggctggcaaggcgcatagnnnn

SEQ ID NO: 281959 - DNA, 155 bp, Homo sapiens; identical to SEQ ID NO: 281555
  misc_feature: GYAE6OF01CJ5LW.1.24.C02.1.454.CMB.1.raw
  modified_base (154)..(155): a, c, t, g, unknown or other
  misc_feature (154)..(155): n is a, c, g, or t

SEQ ID NO: 281960 - DNA, 156 bp, Homo sapiens; identical to SEQ ID NO: 281661
  misc_feature: GYAE6OF01BN9BI.1.24.C02.1.454.CMB.1.raw
  modified_base (154)..(156): a, c, t, g, unknown or other
  misc_feature (154)..(156): n is a, c, g, or t

SEQ ID NO: 281961 - DNA, 154 bp, Homo sapiens; identical to SEQ ID NO: 281552
  misc_feature: GYAE6OF01CZ5DH.1.24.C02.1.454.CMB.1.raw
  modified_base (154)..(154): a, c, t, g, unknown or other
  misc_feature (154)..(154): n is a, c, g, or t

SEQ ID NO: 281962 - DNA, 155 bp, Homo sapiens; identical to SEQ ID NO: 281697
  misc_feature: GYAE6OF01B1WYF.1.24.C02.1.454.CMB.1.raw
  modified_base (154)..(155): a, c, t, g, unknown or other
  misc_feature (154)..(155): n is a, c, g, or t

SEQ ID NO: 281963 - DNA, 154 bp, Homo sapiens; identical to SEQ ID NO: 281614
  misc_feature: GYAE6OF01CQN7N.1.24.C02.1.454.CMB.1.raw
  modified_base (154)..(154): a, c, t, g, unknown or other
  misc_feature (154)..(154): n is a, c, g, or t

SEQ ID NO: 281964 - DNA, 157 bp, Homo sapiens
  misc_feature: GYAE6OF01DOSY8.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnn

SEQ ID NO: 281965 - DNA, 162 bp, Homo sapiens
  misc_feature: GYAE6OF01DQD7M.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnnnnnn

SEQ ID NO: 281966 - DNA, 154 bp, Homo sapiens; identical to SEQ ID NO: 281609
  misc_feature: GYAE6OF01EGWRM.1.24.C02.1.454.CMB.1.raw
  modified_base (154)..(154): a, c, t, g, unknown or other
  misc_feature (154)..(154): n is a, c, g, or t

SEQ ID NO: 281967 - DNA, 156 bp, Homo sapiens; identical to SEQ ID NO: 281595
  misc_feature: GYAE6OF01CT3HU.1.24.C02.1.454.CMB.1.raw
  modified_base (154)..(156): a, c, t, g, unknown or other
  misc_feature (154)..(156): n is a, c, g, or t

SEQ ID NO: 281968 - DNA, 154 bp, Homo sapiens
  misc_feature: GYAE6OF01B9GZ4.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggaaatcaaacgaactgtggctgcaccatctgtcttcatcttcccgccatctgaacgcactcgtctgagcgggctggcaaggcgcatagn

SEQ ID NO: 281969 - DNA, 221 bp, Homo sapiens
  misc_feature: GYAE6OF01EGL88.1.24.C02.1.454.CMB.1.raw
  modified_base (153)..(153): a, c, t, g, unknown or other
  misc_feature (153)..(153): n is a, c, g, or t
  modified_base (159)..(161): a, c, t, g, unknown or other
  misc_feature (159)..(161): n is a, c, g, or t
  modified_base (163)..(221): a, c, t, g, unknown or other
  misc_feature (163)..(221): n is a, c, g, or t
tcagacgagtgcgtcacgaccggtgctcgatttagtacagatcgttagggcaagggaccaaggtggttagatcaaacgaacttgtggctgcaccatcgtgtcttcatcttcccgccagtctgatagcgtacgtctgagcgggctggcaaggcncatagnnntnnnnnnnnnnnnnnnnnnnnnnnnnnnnnnnnnnnnnnnnnnnnnnnnnnnnnnnnnnn

SEQ ID NO: 281970 - DNA, 159 bp, Homo sapiens; identical to SEQ ID NO: 281835
  misc_feature: GYAE6OF01DHFP1.1.24.C02.1.454.CMB.1.raw
  modified_base (154)..(159): a, c, t, g, unknown or other
  misc_feature (154)..(159): n is a, c, g, or t

SEQ ID NO: 281971 - DNA, 154 bp, Homo sapiens; identical to SEQ ID NO: 281552
  misc_feature: GYAE6OF01CFZTU.1.24.C02.1.454.CMB.1.raw
  modified_base (154)..(154): a, c, t, g, unknown or other
  misc_feature (154)..(154): n is a, c, g, or t

SEQ ID NO: 281972 - DNA, 162 bp, Homo sapiens; identical to SEQ ID NO: 281628
  misc_feature: GYAE6OF01DNXVR.1.24.C02.1.454.CMB.1.raw
  modified_base (154)..(162): a, c, t, g, unknown or other
  misc_feature (154)..(162): n is a, c, g, or t

SEQ ID NO: 281973 - DNA, 154 bp, Homo sapiens; identical to SEQ ID NO: 281641
  misc_feature: GYAE6OF01EB10C.1.24.C02.1.454.CMB.1.raw
  modified_base (154)..(154): a, c, t, g, unknown or other
  misc_feature (154)..(154): n is a, c, g, or t

SEQ ID NO: 281974 - DNA, 154 bp, Homo sapiens; identical to SEQ ID NO: 281552
  misc_feature: GYAE6OF01DX2FK.1.24.C02.1.454.CMB.1.raw
  modified_base (154)..(154): a, c, t, g, unknown or other
  misc_feature (154)..(154): n is a, c, g, or t

SEQ ID NO: 281975 - DNA, 154 bp, Homo sapiens; identical to SEQ ID NO: 281607
  misc_feature: GYAE6OF01B571B.1.24.C02.1.454.CMB.1.raw
  modified_base (154)..(154): a, c, t, g, unknown or other
  misc_feature (154)..(154): n is a, c, g, or t

SEQ ID NO: 281976 - DNA, 155 bp, Homo sapiens; identical to SEQ ID NO: 281931
  misc_feature: GYAE6OF01AW8WG.1.24.C02.1.454.CMB.1.raw
  modified_base (154)..(155): a, c, t, g, unknown or other
  misc_feature (154)..(155): n is a, c, g, or t

SEQ ID NO: 281977 - DNA, 154 bp, Homo sapiens; identical to SEQ ID NO: 281552
  misc_feature: GYAE6OF01BJ0FC.1.24.C02.1.454.CMB.1.raw
  modified_base (154)..(154): a, c, t, g, unknown or other
  misc_feature (154)..(154): n is a, c, g, or t

SEQ ID NO: 281978 - DNA, 155 bp, Homo sapiens
  misc_feature: GYAE6OF01CHG0W.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagnn

SEQ ID NO: 281979 - DNA, 156 bp, Homo sapiens; identical to SEQ ID NO: 281566
  misc_feature: GYAE6OF01ADBYW.1.24.C02.1.454.CMB.1.raw
  modified_base (154)..(156): a, c, t, g, unknown or other
  misc_feature (154)..(156): n is a, c, g, or t

SEQ ID NO: 281980 - DNA, 154 bp, Homo sapiens; identical to SEQ ID NO: 281604
  misc_feature: GYAE6OF01DOZKQ.1.24.C02.1.454.CMB.1.raw
  modified_base (154)..(154): a, c, t, g, unknown or other
  misc_feature (154)..(154): n is a, c, g, or t

SEQ ID NO: 281981 - DNA, 154 bp, Homo sapiens; identical to SEQ ID NO: 281552
  misc_feature: GYAE6OF01APYBZ.1.24.C02.1.454.CMB.1.raw
  modified_base (154)..(154): a, c, t, g, unknown or other
  misc_feature (154)..(154): n is a, c, g, or t

SEQ ID NO: 281982 - DNA, 170 bp, Homo sapiens
  misc_feature: GYAE6OF01DLA47.1.24.C02.1.454.CMB.1.raw
  modified_base (155)..(170): a, c, t, g, unknown or other
  misc_feature (155)..(170): n is a, c, g, or t
tcagacgagtgcgtcacgaccggtgctcgatttagtacagatcgttagggaaagggaccaaggtggagatcaaacgaactggtggctgcaccatctgtcttcatcttcccgccatctgaatagcgtactctgagcgggctggcaaggcgcatagnnnnnnnnnnnnnnnn

SEQ ID NO: 281983 - DNA, 162 bp, Homo sapiens
  misc_feature: GYAE6OF01C6HYF.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnnnnnnn

SEQ ID NO: 281984 - DNA, 155 bp, Homo sapiens; identical to SEQ ID NO: 281555
  misc_feature: GYAE6OF01BYL20.1.24.C02.1.454.CMB.1.raw
  modified_base (154)..(155): a, c, t, g, unknown or other
  misc_feature (154)..(155): n is a, c, g, or t

SEQ ID NO: 281985 - DNA, 154 bp, Homo sapiens; identical to SEQ ID NO: 281552
  misc_feature: GYAE6OF01B74WE.1.24.C02.1.454.CMB.1.raw
  modified_base (154)..(154): a, c, t, g, unknown or other
  misc_feature (154)..(154): n is a, c, g, or t

SEQ ID NO: 281986 - DNA, 156 bp, Homo sapiens; identical to SEQ ID NO: 281741
  misc_feature: GYAE6OF01EZIVX.1.24.C02.1.454.CMB.1.raw
  modified_base (154)..(156): a, c, t, g, unknown or other
  misc_feature (154)..(156): n is a, c, g, or t

SEQ ID NO: 281987 - DNA, 154 bp, Homo sapiens; identical to SEQ ID NO: 281607
  misc_feature: GYAE6OF01D380T.1.24.C02.1.454.CMB.1.raw
  modified_base (154)..(154): a, c, t, g, unknown or other
  misc_feature (154)..(154): n is a, c, g, or t

SEQ ID NO: 281988 - DNA, 154 bp, Homo sapiens; identical to SEQ ID NO: 281552
  misc_feature: GYAE6OF01A1DD5.1.24.C02.1.454.CMB.1.raw
  modified_base (154)..(154): a, c, t, g, unknown or other
  misc_feature (154)..(154): n is a, c, g, or t

SEQ ID NO: 281989 - DNA, 155 bp, Homo sapiens
  misc_feature: GYAE6OF01CWHTB.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgtctctactgagcgggctggcaaggcgcatagnn

SEQ ID NO: 281990 - DNA, 160 bp, Homo sapiens; identical to SEQ ID NO: 281714
  misc_feature: GYAE6OF01AYNRN.1.24.C02.1.454.CMB.1.raw
  modified_base (154)..(160): a, c, t, g, unknown or other
  misc_feature (154)..(160): n is a, c, g, or t

SEQ ID NO: 281991 - DNA, 183 bp, Homo sapiens
  misc_feature: GYAE6OF01DLYJR.1.24.C02.1.454.CMB.1.raw
  modified_base (155)..(183): a, c, t, g, unknown or other
  misc_feature (155)..(183): n is a, c, g, or t
tcagacgagtgcgtcacgaccggtgctcgatttagtacagatcgttagggcgaagggaccaaggtggagatcaaacgaactgtggctgcaccatctgtcttcatcttcccgcatctgaatagcgtactctgagcgggctggcaaggtcgcatagnnnnnnnnnnnnnnnnnnnnnnnnnnnnn

SEQ ID NO: 281992 - DNA, 174 bp, Homo sapiens
  misc_feature: GYAE6OF01EQIR0.1.24.C02.1.454.CMB.1.raw
  modified_base (155)..(174): a, c, t, g, unknown or other
  misc_feature (155)..(174): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgaatagcgtactctgagcgggctggcaaggcgcatagnnnnnnnnnnnnnnnnnnnn

SEQ ID NO: 281993 - DNA, 170 bp, Homo sapiens
  misc_feature: GYAE6OF01CEGBI.1.24.C02.1.454.CMB.1.raw
  modified_base (156)..(170): a, c, t, g, unknown or other
  misc_feature (156)..(170): n is a, c, g, or t
tcagacgagtgcgtcacgaccggtgctcgatttagtacagatcgttagggaaagggaccgaacggtggagatcaaacgaactgtggctgcaccatctgtcttcatcttcccgccatctgaacgcactcgtctgagcgggctggcaaggcgcatagnnnnnnnnnnnnnnn

SEQ ID NO: 281994 - DNA, 156 bp, Homo sapiens; identical to SEQ ID NO: 281661
  misc_feature: GYAE6OF01BBKV7.1.24.C02.1.454.CMB.1.raw
  modified_base (154)..(156): a, c, t, g, unknown or other
  misc_feature (154)..(156): n is a, c, g, or t

SEQ ID NO: 281995 - DNA, 153 bp, Homo sapiens
  misc_feature: GYAE6OF01EOST7.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatctcccgccatctgatatacgatcgctgagcgggctggcaaggcgcatagn

SEQ ID NO: 281996 - DNA, 175 bp, Homo sapiens
  misc_feature: GYAE6OF01ADBM3.1.24.C02.1.454.CMB.1.raw
  modified_base (158)..(175): a, c, t, g, unknown or other
  misc_feature (158)..(175): n is a, c, g, or t
tcagacgagtgcgtcacgaccggtgctcgatttagtacagatcgttagggaaagggaccgaaggtggagatcaaaccgaactgtggctgcaccatctgtcttcatccttcccgccatctgaatagcgtactctgagcgggctggccaaggcgcatagnnnnnnnnnnnnnnnnnn

SEQ ID NO: 281997 - DNA, 154 bp, Homo sapiens; identical to SEQ ID NO: 281569
  misc_feature: GYAE6OF01C4YFW.1.24.C02.1.454.CMB.1.raw
  modified_base (154)..(154): a, c, t, g, unknown or other
  misc_feature (154)..(154): n is a, c, g, or t

SEQ ID NO: 281998 - DNA, 154 bp, Homo sapiens
  misc_feature: GYAE6OF01EOJHZ.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagtgcaagggaccaaggtggagatcaaacgaactgtggctgcaccatctgtcttcatcttcccgccatctgactcgtctctactgagcgggctggcaaggcgcatagn

SEQ ID NO: 281999 - DNA, 154 bp, Homo sapiens; identical to SEQ ID NO: 281734
  misc_feature: GYAE6OF01CV4E9.1.24.C02.1.454.CMB.1.raw
  modified_base (154)..(154): a, c, t, g, unknown or other
  misc_feature (154)..(154): n is a, c, g, or t

SEQ ID NO: 282000 - DNA, 168 bp, Homo sapiens
  misc_feature: GYAE6OF01B1TNY.1.24.C02.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacagatcgttagggaaagggaccaaggtggagatcaaacgaactgtggctgacaccatctgtcttcatcttcccgccatctgaacgcactcgtctgagcgggctggcaaggcgcatagnnnnnnnnnnnnnn

SEQ ID NO: 282001 - DNA, 169 bp, Homo sapiens
  misc_feature: GYAE6OF01EPUO8.1.24.C02.1.454.CMB.1.raw
  modified_base (156)..(169): a, c, t, g, unknown or other
  misc_feature (156)..(169): n is a, c, g, or t
tcagacgagtgcgtcacgaccggtgctcgatttagtacagatcgttagggcaagggaccaagggtggagatcaaacgaactgtggctgcaccatctgtcttcatcttcccgccatctgaatacgcgtactctgagcgggctggcaaggcgcatagnnnnnnnnnnnnnn

SEQ ID NO: 282002 - DNA, 153 bp, Homo sapiens
  misc_feature: GYAE6OF01BV8OV.1.24.C02.1.454.CMB.1.raw
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatag

SEQ ID NO: 282003 - DNA, 206 bp, Homo sapiens
  misc_feature: GYAE6OF01DP7N6.1.24.C02.1.454.CMB.1.raw
  modified_base (150)..(206): a, c, t, g, unknown or other
  misc_feature (150)..(206): n is a, c, g, or t
tcagacgagtgcgtcacgaccggtgctcgatttagtacagatcgttagggaaagggaccaaggtggagatcaacgaactgtggctgcaccatctgtcttcatcttcccgcctctcacgtctactgctgagcggctggcaaggcgcatagnnnnnnnnnnnnnnnnnnnnnnnnnnnnnnnnnnnnnnnnnnnnnnnnnnnnnnnnn

SEQ ID NO: 282004 - DNA, 187 bp, Homo sapiens
  misc_feature: GYAE6OF01DZEVN.1.24.C02.1.454.CMB.1.raw
  modified_base (152)..(152): a, c, t, g, unknown or other
  misc_feature (152)..(152): n is a, c, g, or t
  modified_base (158)..(187): a, c, t, g, unknown or other
  misc_feature (158)..(187): n is a, c, g, or t
tcagacgagtgcgtcacgaccggtgctcgatttagtacagatcgttagggaaaggtgaccaagggtggagatcaaactaactgtggctgcaccatctgtcttcatcttccgcatcctgatcgtactggcggctggagcgggctggcaaggcncatagnnnnnnnnnnnnnnnnnnnnnnnnnnnnnn

SEQ ID NO: 282005 - DNA, 155 bp, Homo sapiens
  misc_feature: GYAE6OF01DDY3Y.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnnn

SEQ ID NO: 282006 - DNA, 154 bp, Homo sapiens; identical to SEQ ID NO: 281604
  misc_feature: GYAE6OF01B4TCK.1.24.C02.1.454.CMB.1.raw
  modified_base (154)..(154): a, c, t, g, unknown or other
  misc_feature (154)..(154): n is a, c, g, or t

SEQ ID NO: 282007 - DNA, 155 bp, Homo sapiens
  misc_feature: GYAE6OF01DIMZC.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgcactcgtctgagcgggctggcaaggcgcatagnn

SEQ ID NO: 282008 - DNA, 157 bp, Homo sapiens
  misc_feature: GYAE6OF01ANZC3.1.24.C02.1.454.CMB.1.raw
  modified_base (153)..(157): a, c, t, g, unknown or other
  misc_feature (153)..(157): n is a, c, g, or t
tcagacgagtgcgtcacgaccggtgctcgatttagtacagatcgttaggcaagggaccaaggtggagatcaaacgaactgtggctgcaccatctgtcttcatcttcccgccatctgaatagcgtactctgagcgggctggcaaggcgcatagnnnnn

SEQ ID NO: 282009 - DNA, 154 bp, Homo sapiens; identical to SEQ ID NO: 281609
  misc_feature: GYAE6OF01C8V94.1.24.C02.1.454.CMB.1.raw
  modified_base (154)..(154): a, c, t, g, unknown or other
  misc_feature (154)..(154): n is a, c, g, or t

SEQ ID NO: 282010 - DNA, 154 bp, Homo sapiens; identical to SEQ ID NO: 281681
  misc_feature: GYAE6OF01CZNGU.1.24.C02.1.454.CMB.1.raw
  modified_base (154)..(154): a, c, t, g, unknown or other
  misc_feature (154)..(154): n is a, c, g, or t

SEQ ID NO: 282011 - DNA, 185 bp, Homo sapiens
  misc_feature: GYAE6OF01CCR3Q.1.24.C02.1.454.CMB.1.raw
  modified_base (158)..(185): a, c, t, g, unknown or other
  misc_feature (158)..(185): n is a, c, g, or t
tcagacgagtgcgtcacgaccggtgctcgatttagtacagatcgttagggaaaggtggaccgaaggtggagatcaaactaactggtggctgcacatctgtcttcatcttcccgccatctgatcgtactgcgctgagcgggctgggcaaggcgcatagnnnnnnnnnnnnnnnnnnnnnnnnnnnn

SEQ ID NO: 282012 - DNA, 157 bp, Homo sapiens
  misc_feature: GYAE6OF01EYJ1Y.1.24.C02.1.454.CMB.1.raw
  modified_base (156)..(157): a, c, t, g, unknown or other
  misc_feature (156)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctgggcaaaggcgcatagnn

SEQ ID NO: 282013 - DNA, 154 bp, Homo sapiens; identical to SEQ ID NO: 281552
  misc_feature: GYAE6OF01DVQF0.1.24.C02.1.454.CMB.1.raw
  modified_base (154)..(154): a, c, t, g, unknown or other
  misc_feature (154)..(154): n is a, c, g, or t

SEQ ID NO: 282014 - DNA, 154 bp, Homo sapiens
  misc_feature: GYAE6OF01DF2XO.1.24.C02.1.454.CMB.1.raw
  modified_base (152)..(154): a, c, t, g, unknown or other
  misc_feature (152)..(154): n is a, c, g, or t
tcagacgagtgcgtcacgaccggtgctcgatttagtacagatcgttagggaaagggaccaaggtggagatcaaacgaactgtggctgcaccatctgtcttcatcttccgccatctgatcgtagcactctgagcggctggcaaggcgcatagnnn

SEQ ID NO: 282015 - DNA, 154 bp, Homo sapiens; identical to SEQ ID NO: 281552
  misc_feature: GYAE6OF01CDE8H.1.24.C02.1.454.CMB.1.raw
  modified_base (154)..(154): a, c, t, g, unknown or other
  misc_feature (154)..(154): n is a, c, g, or t

SEQ ID NO: 282016 - DNA, 154 bp, Homo sapiens; identical to SEQ ID NO: 281609
  misc_feature: GYAE6OF01CG24T.1.24.C02.1.454.CMB.1.raw
  modified_base (154)..(154): a, c, t, g, unknown or other
  misc_feature (154)..(154): n is a, c, g, or t

SEQ ID NO: 282017 - DNA, 169 bp, Homo sapiens
  misc_feature: GYAE6OF01EJ2S8.1.24.C02.1.454.CMB.1.raw
  modified_base (156)..(169): a, c, t, g, unknown or other
  misc_feature (156)..(169): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctgggcaaggcgcattagnnnnnnnnnnnnnn

SEQ ID NO: 282018 - DNA, 154 bp, Homo sapiens; identical to SEQ ID NO: 281572
  misc_feature: GYAE6OF01BHRM4.1.24.C02.1.454.CMB.1.raw
  modified_base (154)..(154): a, c, t, g, unknown or other
  misc_feature (154)..(154): n is a, c, g, or t

SEQ ID NO: 282019 - DNA, 154 bp, Homo sapiens; identical to SEQ ID NO: 281552
  misc_feature: GYAE6OF01CCVH1.1.24.C02.1.454.CMB.1.raw
  modified_base (154)..(154): a, c, t, g, unknown or other
  misc_feature (154)..(154): n is a, c, g, or t

SEQ ID NO: 282020 - DNA, 171 bp, Homo sapiens
  misc_feature: GYAE6OF01BP2LT.1.24.C02.1.454.CMB.1.raw
  modified_base (154)..(171): a, c, t, g, unknown or other
  misc_feature (154)..(171): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnnnnnnnnnnnnnnnn

SEQ ID NO: 282021 - DNA, 155 bp, Homo sapiens; identical to SEQ ID NO: 281693
  misc_feature: GYAE6OF01EST0E.1.24.C02.1.454.CMB.1.raw
  modified_base (154)..(155): a, c, t, g, unknown or other
  misc_feature (154)..(155): n is a, c, g, or t

SEQ ID NO: 282022 - DNA, 154 bp, Homo sapiens; identical to SEQ ID NO: 281552
  misc_feature: GYAE6OF01D0L6Q.1.24.C02.1.454.CMB.1.raw
  modified_base (154)..(154): a, c, t, g, unknown or other
  misc_feature (154)..(154): n is a, c, g, or t

SEQ ID NO: 282023 - DNA, 156 bp, Homo sapiens
  misc_feature: GYAE6OF01DJ86C.1.24.C02.1.454.CMB.1.raw
  modified_base (156)..(156): a, c, t, g, unknown or other
  misc_feature (156)..(156): n is a, c, g, or t
tcagacgagtgcgtcacgaccggtgctcgatttagtacagatcgttagggcaagggaccgaaggtggagatcaaacgaactgtggctgaaccatctgtcttcatcttcccgccatctgaatagcgtactctgagcgggctggcaagggcgcatagn

SEQ ID NO: 282024 - DNA, 154 bp, Homo sapiens; identical to SEQ ID NO: 281569
  misc_feature: GYAE6OF01C77WR.1.24.C02.1.454.CMB.1.raw
  modified_base (154)..(154): a, c, t, g, unknown or other
  misc_feature (154)..(154): n is a, c, g, or t

SEQ ID NO: 282025 - DNA, 154 bp, Homo sapiens; identical to SEQ ID NO: 281783
  misc_feature: GYAE6OF01E0HC2.1.24.C02.1.454.CMB.1.raw
  modified_base (154)..(154): a, c, t, g, unknown or other
  misc_feature (154)..(154): n is a, c, g, or t

SEQ ID NO: 282026 - DNA, 162 bp, Homo sapiens
  misc_feature: GYAE6OF01BT9KM.1.24.C02.1.454.CMB.1.raw
  modified_base (155)..(162): a, c, t, g, unknown or other
  misc_feature (155)..(162): n is a, c, g, or t
tcagacgagtgcgtcacgaccggtgctcgatttagtacagatcgttagggcaagggaccaaggtggagatcaaacgaactgtggctgcaccatctgtcttcatcttcccgccatcctgaatagcgtactctgagcgggctggcaaggcgcatagnnnnnnnn

SEQ ID NO: 282027 - DNA, 156 bp, Homo sapiens; identical to SEQ ID NO: 281566
  misc_feature: GYAE6OF01EPM8J.1.24.C02.1.454.CMB.1.raw
  modified_base (154)..(156): a, c, t, g, unknown or other
  misc_feature (154)..(156): n is a, c, g, or t

SEQ ID NO: 282028 - DNA, 155 bp, Homo sapiens
  misc_feature: GYAE6OF01BBJZ0.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgcatagnn

SEQ ID NO: 282029 - DNA, 186 bp, Homo sapiens
  misc_feature: GYAE6OF01AOVQN.1.24.C02.1.454.CMB.1.raw
  modified_base (148)..(148): a, c, t, g, unknown or other
  misc_feature (148)..(148): n is a, c, g, or t
  modified_base (154)..(186): a, c, t, g, unknown or other
  misc_feature (154)..(186): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcncatagnnnnnnnnnnnnnnnnnnnnnnnnnnnnnnnnn

SEQ ID NO: 282030 - DNA, 165 bp, Homo sapiens; identical to SEQ ID NO: 281712
  misc_feature: GYAE6OF01AQWKN.1.24.C02.1.454.CMB.1.raw
  modified_base (154)..(165): a, c, t, g, unknown or other
  misc_feature (154)..(165): n is a, c, g, or t

SEQ ID NO: 282031 - DNA, 154 bp, Homo sapiens; identical to SEQ ID NO: 281552
  misc_feature: GYAE6OF01CYGZY.1.24.C02.1.454.CMB.1.raw
  modified_base (154)..(154): a, c, t, g, unknown or other
  misc_feature (154)..(154): n is a, c, g, or t

SEQ ID NO: 282032 - DNA, 168 bp, Homo sapiens
  misc_feature: GYAE6OF01ASV6S.1.24.C02.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacagatcgttagggcgaagggaccaaggtgtagatcaaacgaactgtggctgcaccatctgtcttcatcttcccgcatctgaatagcgtactctgagcgggctggcaaggcgcattagnnnnnnnnnnnnnn

SEQ ID NO: 282033 - DNA, 175 bp, Homo sapiens
  misc_feature: GYAE6OF01ALDX2.1.24.C02.1.454.CMB.1.raw
  modified_base (151)..(175): a, c, t, g, unknown or other
  misc_feature (151)..(175): n is a, c, g, or t
tcagacgagtgcgtcacgaccggtgctcgatttagtacagatcgttagggaaagggaccgaaggtggagatcaaacgaactgtggctgcaccatctgtcttcatctccgcatctgaatgcgtactctgagcgggctggcaaggcgcatagnnnnnnnnnnnnnnnnnnnnnnnnn

SEQ ID NO: 282034 - DNA, 154 bp, Homo sapiens; identical to SEQ ID NO: 281552
  misc_feature: GYAE6OF01AHJ38.1.24.C02.1.454.CMB.1.raw
  modified_base (154)..(154): a, c, t, g, unknown or other
  misc_feature (154)..(154): n is a, c, g, or t

SEQ ID NO: 282035 - DNA, 159 bp, Homo sapiens; identical to SEQ ID NO: 281835
  misc_feature: GYAE6OF01CVRZY.1.24.C02.1.454.CMB.1.raw
  modified_base (154)..(159): a, c, t, g, unknown or other
  misc_feature (154)..(159): n is a, c, g, or t

SEQ ID NO: 282036 - DNA, 158 bp, Homo sapiens
  misc_feature: GYAE6OF01EOAPO.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgatatacgatcgctgagcgggctggcaaggcgcatagnnnn

SEQ ID NO: 282037 - DNA, 154 bp, Homo sapiens; identical to SEQ ID NO: 281552
  misc_feature: GYAE6OF01BZRF9.1.24.C02.1.454.CMB.1.raw
  modified_base (154)..(154): a, c, t, g, unknown or other
  misc_feature (154)..(154): n is a, c, g, or t

SEQ ID NO: 282038 - DNA, 156 bp, Homo sapiens
  misc_feature: GYAE6OF01AT2HW.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaactaactgtggctgcaccatctgtcttcatcttcccgccatctgatcgtactgcgctgagcgggctggcaaggcgcatagnnn

SEQ ID NO: 282039 - DNA, 154 bp, Homo sapiens; identical to SEQ ID NO: 281552
  misc_feature: GYAE6OF01CT8R8.1.24.C02.1.454.CMB.1.raw
  modified_base (154)..(154): a, c, t, g, unknown or other
  misc_feature (154)..(154): n is a, c, g, or t

SEQ ID NO: 282040 - DNA, 159 bp, Homo sapiens; identical to SEQ ID NO: 281835
  misc_feature: GYAE6OF01B9MAV.1.24.C02.1.454.CMB.1.raw
  modified_base (154)..(159): a, c, t, g, unknown or other
  misc_feature (154)..(159): n is a, c, g, or t

SEQ ID NO: 282041 - DNA, 171 bp, Homo sapiens
  misc_feature: GYAE6OF01CP899.1.24.C02.1.454.CMB.1.raw
  modified_base (155)..(171): a, c, t, g, unknown or other
  misc_feature (155)..(171): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgaacgcactcgtctgagcgggctggcaaggcgcatagnnnnnnnnnnnnnnnnn

SEQ ID NO: 282042 - DNA, 155 bp, Homo sapiens
  misc_feature: GYAE6OF01DUHMO.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtctttatcttcccgccatctgaatagcgtactctgagcgggctggcaaggcgcatagnn

SEQ ID NO: 282043 - DNA, 179 bp, Homo sapiens
  misc_feature: GYAE6OF01EQX70.1.24.C02.1.454.CMB.1.raw
  modified_base (156)..(179): a, c, t, g, unknown or other
  misc_feature (156)..(179): n is a, c, g, or t
tcagacgagtgcgtcacgaccggtgctcgatttagtacagatcgttagggcgaagggaccgaaggtggagatcaaacgaactgtggctgcaccatctgtcttcatcttcccgccatctgaatagcgtactctgagcgggctggcaaggcgcatagnnnnnnnnnnnnnnnnnnnnnnnn

SEQ ID NO: 282044 - DNA, 153 bp, Homo sapiens
  misc_feature: GYAE6OF01CBF45.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcagggaccaaggtggagatcaaacgaactgtggctgcaccatctgtcttcatcttcccgccatctgaatagcgtactctgagcgggctggcaaggcgcatagn

SEQ ID NO: 282045 - DNA, 172 bp, Homo sapiens
  misc_feature: GYAE6OF01CH1V5.1.24.C02.1.454.CMB.1.raw
  modified_base (155)..(172): a, c, t, g, unknown or other
  misc_feature (155)..(172): n is a, c, g, or t
tcagacgagtgcgtcacgaccggtgctcgatttagtacagatcgttagggaaagggtaccaaggtggagatcaaacgaactgtggctgcaccatctgtcttcatcttcccgccatctgaacgcactcgtctgagcgggctggcaaggcgcatagnnnnnnnnnnnnnnnnnn

SEQ ID NO: 282046 - DNA, 152 bp, Homo sapiens
  misc_feature: GYAE6OF01AW3SK.1.24.C02.1.454.CMB.1.raw
tcagacgagtgcgtcacgaccggtgctcgatttagtacagatcgttagggcaagggaccaaggtggagatcaaacgaactgtggctgcaccatctgtcttcatcttcccgccatctgatagcgtactctgagcgggctggcaaggcgcatag

SEQ ID NO: 282047 - DNA, 154 bp, Homo sapiens; identical to SEQ ID NO: 281569
  misc_feature: GYAE6OF01BOQIX.1.24.C02.1.454.CMB.1.raw
  modified_base (154)..(154): a, c, t, g, unknown or other
  misc_feature (154)..(154): n is a, c, g, or t

SEQ ID NO: 282048 - DNA, 155 bp, Homo sapiens; identical to SEQ ID NO: 281693
  misc_feature: GYAE6OF01EGIDJ.1.24.C02.1.454.CMB.1.raw
  modified_base (154)..(155): a, c, t, g, unknown or other
  misc_feature (154)..(155): n is a, c, g, or t

SEQ ID NO: 282049 - DNA, 153 bp, Homo sapiens; identical to SEQ ID NO: 281653
  misc_feature: GYAE6OF01D8K1Y.1.24.C02.1.454.CMB.1.raw

SEQ ID NO: 282050 - DNA, 154 bp, Homo sapiens; identical to SEQ ID NO: 281572
  misc_feature: GYAE6OF01DX33X.1.24.C02.1.454.CMB.1.raw
  modified_base (154)..(154): a, c, t, g, unknown or other
  misc_feature (154)..(154): n is a, c, g, or t

SEQ ID NO: 282051 - DNA, 157 bp, Homo sapiens
  misc_feature: GYAE6OF01CLC1S.1.24.C02.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtacagatcgttagggaaaggtgaccaaggtggagatcaaacgaactgtggctgcaccatctgtcttcatcttcccaccctcctctctctcgactctgagcgggctggcaaggcgcatagnnn

SEQ ID NO: 282052 - DNA, 160 bp, Homo sapiens
  misc_feature: GYAE6OF01DN8F6.1.24.C02.1.454.CMB.1.raw
  modified_base (151)..(160): a, c, t, g, unknown or other
  misc_feature (151)..(160): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagtactctgagcgggctggcaaggcgcatagnnnnnnnnnn

SEQ ID NO: 282053 - DNA, 176 bp, Homo sapiens
  misc_feature: GYAE6OF01BNTTF.1.24.C02.1.454.CMB.1.raw
  modified_base (158)..(176): a, c, t, g, unknown or other
  misc_feature (158)..(176): n is a, c, g, or t
tcagacgagtgcgtcacgaccggtgctcgatttagtacagatcgttagggaaagggaccgaaggtggagactcaaacgaactgtggctgcaccatctgtcttccatcttcccgccatctgatcgtagcactctgagccgggctggcaaggcgcatagnnnnnnnnnnnnnnnnnnn

SEQ ID NO: 282054 - DNA, 166 bp, Homo sapiens
  misc_feature: GYAE6OF01AHY20.1.24.C02.1.454.CMB.1.raw
  modified_base (154)..(166): a, c, t, g, unknown or other
  misc_feature (154)..(166): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnnnnnnnnnnnn

SEQ ID NO: 282055 - DNA, 154 bp, Homo sapiens; identical to SEQ ID NO: 281572
  misc_feature: GYAE6OF01DA4EX.1.24.C02.1.454.CMB.1.raw
  modified_base (154)..(154): a, c, t, g, unknown or other
  misc_feature (154)..(154): n is a, c, g, or t

SEQ ID NO: 282056 - DNA, 154 bp, Homo sapiens; identical to SEQ ID NO: 281552
  misc_feature: GYAE6OF01BP8EX.1.24.C02.1.454.CMB.1.raw
  modified_base (154)..(154): a, c, t, g, unknown or other
  misc_feature (154)..(154): n is a, c, g, or t

SEQ ID NO: 282057 - DNA, 155 bp, Homo sapiens; identical to SEQ ID NO: 281799
  misc_feature: GYAE6OF01AOPPM.1.24.C02.1.454.CMB.1.raw
  modified_base (154)..(155): a, c, t, g, unknown or other
  misc_feature (154)..(155): n is a, c, g, or t

SEQ ID NO: 282058 - DNA, 154 bp, Homo sapiens; identical to SEQ ID NO: 281552
  misc_feature: GYAE6OF01BT2RY.1.24.C02.1.454.CMB.1.raw
  modified_base (154)..(154): a, c, t, g, unknown or other
  misc_feature (154)..(154): n is a, c, g, or t

SEQ ID NO: 282059 - DNA, 154 bp, Homo sapiens; identical to SEQ ID NO: 281572
  misc_feature: GYAE6OF01A8WG2.1.24.C02.1.454.CMB.1.raw
  modified_base (154)..(154): a, c, t, g, unknown or other
  misc_feature (154)..(154): n is a, c, g, or t

SEQ ID NO: 282060 - DNA, 159 bp, Homo sapiens
  misc_feature: GYAE6OF01A8MXZ.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnnnnn

SEQ ID NO: 282061 - DNA, 154 bp, Homo sapiens; identical to SEQ ID NO: 281552
  misc_feature: GYAE6OF01A5RCJ.1.24.C02.1.454.CMB.1.raw
  modified_base (154)..(154): a, c, t, g, unknown or other
  misc_feature (154)..(154): n is a, c, g, or t

SEQ ID NO: 282062 - DNA, 154 bp, Homo sapiens; identical to SEQ ID NO: 281572
  misc_feature: GYAE6OF01EJZI5.1.24.C02.1.454.CMB.1.raw
  modified_base (154)..(154): a, c, t, g, unknown or other
  misc_feature (154)..(154): n is a, c, g, or t

SEQ ID NO: 282063 - DNA, 154 bp, Homo sapiens; identical to SEQ ID NO: 281598
  misc_feature: GYAE6OF01DEX0Q.1.24.C02.1.454.CMB.1.raw
  modified_base (154)..(154): a, c, t, g, unknown or other
  misc_feature (154)..(154): n is a, c, g, or t

SEQ ID NO: 282064 - DNA, 172 bp, Homo sapiens
  misc_feature: GYAE6OF01CEJEF.1.24.C02.1.454.CMB.1.raw
  modified_base (153)..(172): a, c, t, g, unknown or other
  misc_feature (153)..(172): n is a, c, g, or t
tcagacgagtgcgtcacgaccggtgctcgatttagtacagatcgttagggaaagggtaccgaaggtggagatacaaacgaactgtggctgcaccatctgtcttcatcttcccgccactgtacgatcgctgagcgggctggcaaggcgcatagnnnnnnnnnnnnnnnnnnnn

SEQ ID NO: 282065 - DNA, 213 bp, Homo sapiens
  misc_feature: GYAE6OF01D8PTC.1.24.C02.1.454.CMB.1.raw
  modified_base (163)..(164): a, c, t, g, unknown or other
  misc_feature (163)..(164): n is a, c, g, or t
  modified_base (166)..(213): a, c, t, g, unknown or other
  misc_feature (166)..(213): n is a, c, g, or t
tcagacgagtgcgtcacgaccggtgctcgatttagtacagatcgttagggaaagggtaccgaaggtggagatcaaacgaactgtggctgcaccatcgtcgtcttcatccttcccgcgatcctgatcgtagcactcgtggagccgggctggcaaggcgcatagnncnnnnnnnnnnnnnnnnnnnnnnnnnnnnnnnnnnnnnnnnnnnnnnnn

SEQ ID NO: 282066 - DNA, 163 bp, Homo sapiens; identical to SEQ ID NO: 281559
  misc_feature: GYAE6OF01DUCB7.1.24.C02.1.454.CMB.1.raw
  modified_base (154)..(163): a, c, t, g, unknown or other
  misc_feature (154)..(163): n is a, c, g, or t

SEQ ID NO: 282067 - DNA, 154 bp, Homo sapiens; identical to SEQ ID NO: 281609
  misc_feature: GYAE6OF01DR492.1.24.C02.1.454.CMB.1.raw
  modified_base (154)..(154): a, c, t, g, unknown or other
  misc_feature (154)..(154): n is a, c, g, or t

SEQ ID NO: 282068 - DNA, 164 bp, Homo sapiens
  misc_feature: GYAE6OF01AU2LT.1.24.C02.1.454.CMB.1.raw
  modified_base (155)..(164): a, c, t, g, unknown or other
  misc_feature (155)..(164): n is a, c, g, or t
tcagacgagtgcgtcacgaccggtgctcgatttagtacagatcgttagtgcgaagggaccaaggtggagatcaaacgaactgtggctgcaccatctgtcttcatcttcccgccatctgactcgtctctactgagcgggctggcaaggcgcatagnnnnnnnnnn

SEQ ID NO: 282069 - DNA, 168 bp, Homo sapiens
  misc_feature: GYAE6OF01CFAM0.1.24.C02.1.454.CMB.1.raw
  modified_base (154)..(168): a, c, t, g, unknown or other
  misc_feature (154)..(168): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnnnnnnnnnnnnnn

SEQ ID NO: 282070 - DNA, 155 bp, Homo sapiens
  misc_feature: GYAE6OF01BANLG.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaacgtctactgctgagcgggctggcaaggcgcatagnn

SEQ ID NO: 282071 - DNA, 154 bp, Homo sapiens; identical to SEQ ID NO: 281572
  misc_feature: GYAE6OF01EDD5M.1.24.C02.1.454.CMB.1.raw
  modified_base (154)..(154): a, c, t, g, unknown or other
  misc_feature (154)..(154): n is a, c, g, or t

SEQ ID NO: 282072 - DNA, 155 bp, Homo sapiens; identical to SEQ ID NO: 281931
  misc_feature: GYAE6OF01BGJDN.1.24.C02.1.454.CMB.1.raw
  modified_base (154)..(155): a, c, t, g, unknown or other
  misc_feature (154)..(155): n is a, c, g, or t

SEQ ID NO: 282073 - DNA, 157 bp, Homo sapiens; identical to SEQ ID NO: 281599
  misc_feature: GYAE6OF01B2318.1.24.C02.1.454.CMB.1.raw
  modified_base (154)..(157): a, c, t, g, unknown or other
  misc_feature (154)..(157): n is a, c, g, or t

SEQ ID NO: 282074 - DNA, 160 bp, Homo sapiens
  misc_feature: GYAE6OF01EOGQF.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatagnnnnnnn

SEQ ID NO: 282075 - DNA, 154 bp, Homo sapiens; identical to SEQ ID NO: 281552
  misc_feature: GYAE6OF01D7X2A.1.24.C02.1.454.CMB.1.raw
  modified_base (154)..(154): a, c, t, g, unknown or other
  misc_feature (154)..(154): n is a, c, g, or t

SEQ ID NO: 282076 - DNA, 154 bp, Homo sapiens; identical to SEQ ID NO: 281604
  misc_feature: GYAE6OF01EXMW9.1.24.C02.1.454.CMB.1.raw
  modified_base (154)..(154): a, c, t, g, unknown or other
  misc_feature (154)..(154): n is a, c, g, or t

SEQ ID NO: 282077 - DNA, 154 bp, Homo sapiens; identical to SEQ ID NO: 281552
  misc_feature: GYAE6OF01DC9OS.1.24.C02.1.454.CMB.1.raw
  modified_base (154)..(154): a, c, t, g, unknown or other
  misc_feature (154)..(154): n is a, c, g, or t

SEQ ID NO: 282078 - DNA, 154 bp, Homo sapiens; identical to SEQ ID NO: 281604
  misc_feature: GYAE6OF01C2SO4.1.24.C02.1.454.CMB.1.raw
  modified_base (154)..(154): a, c, t, g, unknown or other
  misc_feature (154)..(154): n is a, c, g, or t

SEQ ID NO: 282079 - DNA, 154 bp, Homo sapiens; identical to SEQ ID NO: 281552
  misc_feature: GYAE6OF01B7EW8.1.24.C02.1.454.CMB.1.raw
  modified_base (154)..(154): a, c, t, g, unknown or other
  misc_feature (154)..(154): n is a, c, g, or t

SEQ ID NO: 282080 - DNA, 156 bp, Homo sapiens; identical to SEQ ID NO: 281661
  misc_feature: GYAE6OF01E5SH7.1.24.C02.1.454.CMB.1.raw
  modified_base (154)..(156): a, c, t, g, unknown or other
  misc_feature (154)..(156): n is a, c, g, or t

SEQ ID NO: 282081 - DNA, 154 bp, Homo sapiens; identical to SEQ ID NO: 281552
  misc_feature: GYAE6OF01C1HFP.1.24.C02.1.454.CMB.1.raw
  modified_base (154)..(154): a, c, t, g, unknown or other
  misc_feature (154)..(154): n is a, c, g, or t

SEQ ID NO: 282082 - DNA, 154 bp, Homo sapiens; identical to SEQ ID NO: 281552
  misc_feature: GYAE6OF01BNKJS.1.24.C02.1.454.CMB.1.raw
  modified_base (154)..(154): a, c, t, g, unknown or other
  misc_feature (154)..(154): n is a, c, g, or t

SEQ ID NO: 282083 - DNA, 192 bp, Homo sapiens
  misc_feature: GYAE6OF01AQVHM.1.24.C02.1.454.CMB.1.raw
  modified_base (157)..(158): a, c, t, g, unknown or other
  misc_feature (157)..(158): n is a, c, g, or t
  modified_base (160)..(192): a, c, t, g, unknown or other
  misc_feature (160)..(192): n is a, c, g, or t
tcagacgagtgcgtcacgaccggtgctcgatttagtacagatcgttaggggaaacgggaccgaaggtggagatcaaacgaactgtggctgcaccatctgtcttcatcttcccgccatctgatatacgatcgctgagcgggctggcaaggcgcatagnnannnnnnnnnnnnnnnnnnnnnnnnnnnnnnnnn

SEQ ID NO: 282084 - DNA, 154 bp, Homo sapiens; identical to SEQ ID NO: 281552
  misc_feature: GYAE6OF01A0TM6.1.24.C02.1.454.CMB.1.raw
  modified_base (154)..(154): a, c, t, g, unknown or other
  misc_feature (154)..(154): n is a, c, g, or t

SEQ ID NO: 282085 - DNA, 155 bp, Homo sapiens; identical to SEQ ID NO: 281693
  misc_feature: GYAE6OF01BRA5P.1.24.C02.1.454.CMB.1.raw
  modified_base (154)..(155): a, c, t, g, unknown or other
  misc_feature (154)..(155): n is a, c, g, or t

SEQ ID NO: 282086 - DNA, 186 bp, Homo sapiens
  misc_feature: GYAE6OF01EL5M3.1.24.C02.1.454.CMB.1.raw
  modified_base (155)..(186): a, c, t, g, unknown or other
  misc_feature (155)..(186): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctagagcgggctggcaaggcgcatagnnnnnnnnnnnnnnnnnnnnnnnnnnnnnnnn

SEQ ID NO: 282087 - DNA, 175 bp, Homo sapiens
  misc_feature: GYAE6OF01CGTX6.1.24.C02.1.454.CMB.1.raw
  modified_base (151)..(175): a, c, t, g, unknown or other
  misc_feature (151)..(175): n is a, c, g, or t
tcagacgagtgcgtcacgaccggtgctcgatttagtacagatcgttagggaaaggaccaaggtggagatcaaacgaactgtggctgcaccatctgtcttcatcttcccgccatctgatctctcgactctgagcggctggcaaggcgcatgnnnnnnnnnnnnnnnnnnnnnnnnn

SEQ ID NO: 282088 - DNA, 186 bp, Homo sapiens
  misc_feature: GYAE6OF01DT185.1.24.C02.1.454.CMB.1.raw
  modified_base (153)..(153): a, c, t, g, unknown or other
  misc_feature (153)..(153): n is a, c, g, or t
  modified_base (159)..(186): a, c, t, g, unknown or other
  misc_feature (159)..(186): n is a, c, g, or t
tcagacgagtgcgtcacgaccggtgctcgatttagtacagatcgttagggcgaaagggaccaaggtggagatcaaaacgaactgtggctgaaccatctgtcttcatcttcccgccattctgaattagcgtactctgagcgggctggcaaggcncatagnnnnnnnnnnnnnnnnnnnnnnnnnnnn

SEQ ID NO: 282089 - DNA, 196 bp, Homo sapiens
  misc_feature: GYAE6OF01ANT0R.1.24.C02.1.454.CMB.1.raw
  modified_base (160)..(196): a, c, t, g, unknown or other
  misc_feature (160)..(196): n is a, c, g, or t
tcagacgagtgcgtcacgaccggtgctcgatttagtacagatcgttagggaaagggtaccgaaggtggagatcaaacgaactgtggctgcaccatctgtcttcatcttcccgcatctgactcgcgatagtctgaggcgggctgggcgaaggtcgcatagnnnnnnnnnnnnnnnnnnnnnnnnnnnnnnnnnnnnn

SEQ ID NO: 282090 - DNA, 155 bp, Homo sapiens; identical to SEQ ID NO: 281575
  misc_feature: GYAE6OF01BBISH.1.24.C02.1.454.CMB.1.raw
  modified_base (154)..(155): a, c, t, g, unknown or other
  misc_feature (154)..(155): n is a, c, g, or t

SEQ ID NO: 282091 - DNA, 155 bp, Homo sapiens; identical to SEQ ID NO: 281555
  misc_feature: GYAE6OF01C21EJ.1.24.C02.1.454.CMB.1.raw
  modified_base (154)..(155): a, c, t, g, unknown or other
  misc_feature (154)..(155): n is a, c, g, or t

SEQ ID NO: 282092 - DNA, 154 bp, Homo sapiens; identical to SEQ ID NO: 281552
  misc_feature: GYAE6OF01CUSLT.1.24.C02.1.454.CMB.1.raw
  modified_base (154)..(154): a, c, t, g, unknown or other
  misc_feature (154)..(154): n is a, c, g, or t

SEQ ID NO: 282093 - DNA, 173 bp, Homo sapiens
  misc_feature: GYAE6OF01DAAPF.1.24.C02.1.454.CMB.1.raw
  modified_base (157)..(173): a, c, t, g, unknown or other
  misc_feature (157)..(173): n is a, c, g, or t
tcagacgagtgcgtcacgaccggtgctcgatttagtacagatcgttagggcaagggaccaaggtggagatcaaacgaactgtggctgcaccatctgtcttcatccttcccgccatctgaatagcgtactctgagcgggctgggcaaggcgtcatagnnnnnnnnnnnnnnnnn

SEQ ID NO: 282094 - DNA, 155 bp, Homo sapiens; identical to SEQ ID NO: 281575
  misc_feature: GYAE6OF01EUS9T.1.24.C02.1.454.CMB.1.raw
  modified_base (154)..(155): a, c, t, g, unknown or other
  misc_feature (154)..(155): n is a, c, g, or t

SEQ ID NO: 282095 - DNA, 154 bp, Homo sapiens; identical to SEQ ID NO: 281706
  misc_feature: GYAE6OF01BCIPS.1.24.C02.1.454.CMB.1.raw
  modified_base (154)..(154): a, c, t, g, unknown or other
  misc_feature (154)..(154): n is a, c, g, or t

SEQ ID NO: 282096 - DNA, 159 bp, Homo sapiens; identical to SEQ ID NO: 281835
  misc_feature: GYAE6OF01BCFQV.1.24.C02.1.454.CMB.1.raw
  modified_base (154)..(159): a, c, t, g, unknown or other
  misc_feature (154)..(159): n is a, c, g, or t

SEQ ID NO: 282097 - DNA, 157 bp, Homo sapiens; identical to SEQ ID NO: 281599
  misc_feature: GYAE6OF01DCD0Z.1.24.C02.1.454.CMB.1.raw
  modified_base (154)..(157): a, c, t, g, unknown or other
  misc_feature (154)..(157): n is a, c, g, or t

SEQ ID NO: 282098 - DNA, 154 bp, Homo sapiens; identical to SEQ ID NO: 281572
  misc_feature: GYAE6OF01CBVXQ.1.24.C02.1.454.CMB.1.raw
  modified_base (154)..(154): a, c, t, g, unknown or other
  misc_feature (154)..(154): n is a, c, g, or t

SEQ ID NO: 282099 - DNA, 154 bp, Homo sapiens; identical to SEQ ID NO: 281614
  misc_feature: GYAE6OF01B7IM3.1.24.C02.1.454.CMB.1.raw
  modified_base (154)..(154): a, c, t, g, unknown or other
  misc_feature (154)..(154): n is a, c, g, or t

SEQ ID NO: 282100 - DNA, 155 bp, Homo sapiens; identical to SEQ ID NO: 281865
  misc_feature: GYAE6OF01D8HMD.1.24.C02.1.454.CMB.1.raw
  modified_base (154)..(155): a, c, t, g, unknown or other
  misc_feature (154)..(155): n is a, c, g, or t

SEQ ID NO: 282101 - DNA, 156 bp, Homo sapiens
  misc_feature: GYAE6OF01APU1B.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatctttccgccatctgatatacgatcgctgagcgggctggcaaggcgcatagnnn

SEQ ID NO: 282102 - DNA, 190 bp, Homo sapiens
  misc_feature: GYAE6OF01CZ43S.1.24.C02.1.454.CMB.1.raw
  modified_base (162)..(190): a, c, t, g, unknown or other
  misc_feature (162)..(190): n is a, c, g, or t
tcagacgagtgcgtcacgaccggtgctcgatttagtacagatcgttagggaaagggaccaaggtagggacgaatcaaaccgaactggtggctcgcaccatctgtcttcatcttcccgcagtctgaatagcgtactctggagcgggctggcaaggcgcatagnnnnnnnnnnnnnnnnnnnnnnnnnnnnn

SEQ ID NO: 282103 - DNA, 162 bp, Homo sapiens
  misc_feature: GYAE6OF01CP8HI.1.24.C02.1.454.CMB.1.raw
  modified_base (155)..(162): a, c, t, g, unknown or other
  misc_feature (155)..(162): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgaatagcgtactctgagcgggctggcaaggcgcatagnnnnnnnn

SEQ ID NO: 282104 - DNA, 171 bp, Homo sapiens
  misc_feature: GYAE6OF01AHM3F.1.24.C02.1.454.CMB.1.raw
  modified_base (156)..(171): a, c, t, g, unknown or other
  misc_feature (156)..(171): n is a, c, g, or t
tcagacgagtgcgtcacgaccggtgctcgatttagtacagatcgttagggaaagggaccgaaggtggagatcaaacgaactgtggctgcaccatctgtcttaatcttcccgccatctgactcgcgatatctgagcgggctggcaaggcgtcatagnnnnnnnnnnnnnnnn

SEQ ID NO: 282105 - DNA, 155 bp, Homo sapiens; identical to SEQ ID NO: 281753
  misc_feature: GYAE6OF01DXW6C.1.24.C02.1.454.CMB.1.raw
  modified_base (154)..(155): a, c, t, g, unknown or other
  misc_feature (154)..(155): n is a, c, g, or t

SEQ ID NO: 282106 - DNA, 155 bp, Homo sapiens; identical to SEQ ID NO: 281693
  misc_feature: GYAE6OF01BR44Q.1.24.C02.1.454.CMB.1.raw
  modified_base (154)..(155): a, c, t, g, unknown or other
  misc_feature (154)..(155): n is a, c, g, or t

SEQ ID NO: 282107 - DNA, 155 bp, Homo sapiens; identical to SEQ ID NO: 281675
  misc_feature: GYAE6OF01EB1ZC.1.24.C02.1.454.CMB.1.raw
  modified_base (154)..(155): a, c, t, g, unknown or other
  misc_feature (154)..(155): n is a, c, g, or t

SEQ ID NO: 282108 - DNA, 154 bp, Homo sapiens; identical to SEQ ID NO: 281569
  misc_feature: GYAE6OF01EXBFW.1.24.C02.1.454.CMB.1.raw
  modified_base (154)..(154): a, c, t, g, unknown or other
  misc_feature (154)..(154): n is a, c, g, or t

SEQ ID NO: 282109 - DNA, 155 bp, Homo sapiens
  misc_feature: GYAE6OF01EOGAR.1.24.C02.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtacagatcgttagggaaagggaccaaggtggagattaaacgaactgtggctgcaccatctgtcttcatcttcccgccatctgaacgcactcgtctgagcgggctgggcaaggcgcatagn

SEQ ID NO: 282110 - DNA, 156 bp, Homo sapiens; identical to SEQ ID NO: 281741
  misc_feature: GYAE6OF01CJB9V.1.24.C02.1.454.CMB.1.raw
  modified_base (154)..(156): a, c, t, g, unknown or other
  misc_feature (154)..(156): n is a, c, g, or t

SEQ ID NO: 282111 - DNA, 161 bp, Homo sapiens
  misc_feature: GYAE6OF01C81MT.1.24.C02.1.454.CMB.1.raw
  modified_base (152)..(161): a, c, t, g, unknown or other
  misc_feature (152)..(161): n is a, c, g, or t
tcagacgagtgcgtcacgaccggtgctcgatttagtacagatcgttagggcaagggaccaaggtggagatcaaacgaactgtggctgcaccatctgtcttcatcttcccacctctcacgtagcgtgctgagcgggctggcaaggcgcatagnnnnnnnnnn

SEQ ID NO: 282112 - DNA, 154 bp, Homo sapiens
  misc_feature: GYAE6OF01D8WVU.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggtaagggaccaatgtggagatcaaacgaactgtggctgcaccatctgtcttcatcttcccgccatctgagagtgcgtctctgagcgggctggcaaggcgcatagn

SEQ ID NO: 282113 - DNA, 155 bp, Homo sapiens
  misc_feature: GYAE6OF01C3JW0.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttaggcaagggaccaaggtggagatcaaacgaactgtggctgcaccatctgtcttcatcttcccgccatctgaatagcgtactctgagcgggctggcaaggcgcatagnnn

SEQ ID NO: 282114 - DNA, 154 bp, Homo sapiens; identical to SEQ ID NO: 281569
  misc_feature: GYAE6OF01EES9Q.1.24.C02.1.454.CMB.1.raw
  modified_base (154)..(154): a, c, t, g, unknown or other
  misc_feature (154)..(154): n is a, c, g, or t

SEQ ID NO: 282115 - DNA, 186 bp, Homo sapiens
  misc_feature: GYAE6OF01EEWGB.1.24.C02.1.454.CMB.1.raw
  modified_base (157)..(186): a, c, t, g, unknown or other
  misc_feature (157)..(186): n is a, c, g, or t
tcagacgagtgcgtcacgaccggtgctcgatttagtacagatcgttagggcgaagggaccaaggtggagatcaaacgaactgtggctgcaccatcctgtcttcactcttcccgccatctgatatgtatactctgagcgggctggcaaggcgcatagnnnnnnnnnnnnnnnnnnnnnnnnnnnnnn

SEQ ID NO: 282116 - DNA, 154 bp, Homo sapiens; identical to SEQ ID NO: 281552
  misc_feature: GYAE6OF01AKSZC.1.24.C02.1.454.CMB.1.raw
  modified_base (154)..(154): a, c, t, g, unknown or other
  misc_feature (154)..(154): n is a, c, g, or t

SEQ ID NO: 282117 - DNA, 155 bp, Homo sapiens; identical to SEQ ID NO: 281575
  misc_feature: GYAE6OF01BW27E.1.24.C02.1.454.CMB.1.raw
  modified_base (154)..(155): a, c, t, g, unknown or other
  misc_feature (154)..(155): n is a, c, g, or t

SEQ ID NO: 282118 - DNA, 155 bp, Homo sapiens; identical to SEQ ID NO: 281575
  misc_feature: GYAE6OF01CA052.1.24.C02.1.454.CMB.1.raw
  modified_base (154)..(155): a, c, t, g, unknown or other
  misc_feature (154)..(155): n is a, c, g, or t

SEQ ID NO: 282119 - DNA, 159 bp, Homo sapiens
  misc_feature: GYAE6OF01EE95V.1.24.C02.1.454.CMB.1.raw
  modified_base (156)..(159): a, c, t, g, unknown or other
  misc_feature (156)..(159): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgaacgcactcgtctggagcgggctggcaaggcgcatagnnnn

SEQ ID NO: 282120 - DNA, 172 bp, Homo sapiens
  misc_feature: GYAE6OF01DNF1S.1.24.C02.1.454.CMB.1.raw
  modified_base (149)..(149): a, c, t, g, unknown or other
  misc_feature (149)..(149): n is a, c, g, or t
  modified_base (154)..(172): a, c, t, g, unknown or other
  misc_feature (154)..(172): n is a, c, g, or t
tcagacgagtgcgtcacgaccggtgctcgatttagtacagatcgttagggcaagggaccaaggtggagatcaaacgaactgtggcctgcaccatctgtcttcatcttcccgccatctgaatgcgtactctgagccggctggcaaggcgnatagnnnnnnnnnnnnnnnnnnn

SEQ ID NO: 282121 - DNA, 154 bp, Homo sapiens; identical to SEQ ID NO: 281604
  misc_feature: GYAE6OF01CP2N4.1.24.C02.1.454.CMB.1.raw
  modified_base (154)..(154): a, c, t, g, unknown or other
  misc_feature (154)..(154): n is a, c, g, or t

SEQ ID NO: 282122 - DNA, 156 bp, Homo sapiens; identical to SEQ ID NO: 281888
  misc_feature: GYAE6OF01BNQI7.1.24.C02.1.454.CMB.1.raw
  modified_base (154)..(156): a, c, t, g, unknown or other
  misc_feature (154)..(156): n is a, c, g, or t

SEQ ID NO: 282123 - DNA, 155 bp, Homo sapiens; identical to SEQ ID NO: 281555
  misc_feature: GYAE6OF01A8MIN.1.24.C02.1.454.CMB.1.raw
  modified_base (154)..(155): a, c, t, g, unknown or other
  misc_feature (154)..(155): n is a, c, g, or t

SEQ ID NO: 282124 - DNA, 156 bp, Homo sapiens
  misc_feature: GYAE6OF01A516R.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggcaagggaccaaggtggagatcaaacgaactgtggctgcaccatctgtcttcatcttcccgccctcctcacgtagcgtgctgagcgggctggcaaggcgcatagnnn

SEQ ID NO: 282125 - DNA, 155 bp, Homo sapiens; identical to SEQ ID NO: 281555
  misc_feature: GYAE6OF01EZUVK.1.24.C02.1.454.CMB.1.raw
  modified_base (154)..(155): a, c, t, g, unknown or other
  misc_feature (154)..(155): n is a, c, g, or t

SEQ ID NO: 282126 - DNA, 168 bp, Homo sapiens
  misc_feature: GYAE6OF01DCUTV.1.24.C02.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacagatcgttagggcgaagggaccaaggtggagatcaaacgaactgtggctgaaccatctgtcttcatcttcccgccatctgaatagcgtactctgagcgggctggcaaggcgcatagnnnnnnnnnnnnnn

SEQ ID NO: 282127 - DNA, 153 bp, Homo sapiens
  misc_feature: GYAE6OF01CU241.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagn

SEQ ID NO: 282128 - DNA, 154 bp, Homo sapiens; identical to SEQ ID NO: 281569
  misc_feature: GYAE6OF01CSSCF.1.24.C02.1.454.CMB.1.raw
  modified_base (154)..(154): a, c, t, g, unknown or other
  misc_feature (154)..(154): n is a, c, g, or t

SEQ ID NO: 282129 - DNA, 162 bp, Homo sapiens
  misc_feature: GYAE6OF01E4NLX.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatagnnnnnnnnn

SEQ ID NO: 282130 - DNA, 156 bp, Homo sapiens; identical to SEQ ID NO: 281661
  misc_feature: GYAE6OF01BIDWM.1.24.C02.1.454.CMB.1.raw
  modified_base (154)..(156): a, c, t, g, unknown or other
  misc_feature (154)..(156): n is a, c, g, or t

SEQ ID NO: 282131 - DNA, 154 bp, Homo sapiens; identical to SEQ ID NO: 281607
  misc_feature: GYAE6OF01D0SMX.1.24.C02.1.454.CMB.1.raw
  modified_base (154)..(154): a, c, t, g, unknown or other
  misc_feature (154)..(154): n is a, c, g, or t

SEQ ID NO: 282132 - DNA, 155 bp, Homo sapiens; identical to SEQ ID NO: 281799
  misc_feature: GYAE6OF01BNQNO.1.24.C02.1.454.CMB.1.raw
  modified_base (154)..(155): a, c, t, g, unknown or other
  misc_feature (154)..(155): n is a, c, g, or t

SEQ ID NO: 282133 - DNA, 172 bp, Homo sapiens
  misc_feature: GYAE6OF01CZCUR.1.24.C02.1.454.CMB.1.raw
  modified_base (156)..(172): a, c, t, g, unknown or other
  misc_feature (156)..(172): n is a, c, g, or t
tcagacgagtgcgtcacgaccggtgctcgatttagtacagatcgttagggcgaaggggaccaaggtgtagatcaaacgaactgtggctgcaccatctgtcttcatcttcccgccatctgaatagcgtactctgagcgggctggcaaggcgcatagnnnnnnnnnnnnnnnnn

SEQ ID NO: 282134 - DNA, 154 bp, Homo sapiens; identical to SEQ ID NO: 281641
  misc_feature: GYAE6OF01DY5P1.1.24.C02.1.454.CMB.1.raw
  modified_base (154)..(154): a, c, t, g, unknown or other
  misc_feature (154)..(154): n is a, c, g, or t

SEQ ID NO: 282135 - DNA, 155 bp, Homo sapiens; identical to SEQ ID NO: 281753
  misc_feature: GYAE6OF01C46FU.1.24.C02.1.454.CMB.1.raw
  modified_base (154)..(155): a, c, t, g, unknown or other
  misc_feature (154)..(155): n is a, c, g, or t

SEQ ID NO: 282136 - DNA, 154 bp, Homo sapiens; identical to SEQ ID NO: 281576
  misc_feature: GYAE6OF01BBUNM.1.24.C02.1.454.CMB.1.raw
  modified_base (154)..(154): a, c, t, g, unknown or other
  misc_feature (154)..(154): n is a, c, g, or t

SEQ ID NO: 282137 - DNA, 173 bp, Homo sapiens
  misc_feature: GYAE6OF01BEGGK.1.24.C02.1.454.CMB.1.raw
  modified_base (157)..(173): a, c, t, g, unknown or other
  misc_feature (157)..(173): n is a, c, g, or t
tcagacgagtgcgtcacgaccggtgctcgatttagtacagatcgttagggaaaggggaccaaggtggagatcaaacgaactgtggctgcaccatctgtccttcatcttcccaccctcctcacgtagcgtgctgaggcgggctggcaaggcgcatagnnnnnnnnnnnnnnnnn

SEQ ID NO: 282138 - DNA, 155 bp, Homo sapiens; identical to SEQ ID NO: 281675
  misc_feature: GYAE6OF01CTSXG.1.24.C02.1.454.CMB.1.raw
  modified_base (154)..(155): a, c, t, g, unknown or other
  misc_feature (154)..(155): n is a, c, g, or t

SEQ ID NO: 282139 - DNA, 155 bp, Homo sapiens; identical to SEQ ID NO: 281555
  misc_feature: GYAE6OF01D7XKS.1.24.C02.1.454.CMB.1.raw
  modified_base (154)..(155): a, c, t, g, unknown or other
  misc_feature (154)..(155): n is a, c, g, or t

SEQ ID NO: 282140 - DNA, 191 bp, Homo sapiens
  misc_feature: GYAE6OF01C3BGM.1.24.C02.1.454.CMB.1.raw
  modified_base (142)..(142): a, c, t, g, unknown or other
  misc_feature (142)..(142): n is a, c, g, or t
  modified_base (148)..(191): a, c, t, g, unknown or other
  misc_feature (148)..(191): n is a, c, g, or t
tcagacgagtgcgtcacgaccggtgctcgatttagtacagatcgttagggaaagggaccaaggtggagatcaaacgaactgtggctgcaccatctgtcttcatcttcccacctctcacgtctactgagcggctggcaaggcncatagnnnnnnnnnnnnnnnnnnnnnnnnnnnnnnnnnnnnnnnnnnnn

SEQ ID NO: 282141 - DNA, 154 bp, Homo sapiens; identical to SEQ ID NO: 281681
  misc_feature: GYAE6OF01DS3JU.1.24.C02.1.454.CMB.1.raw
  modified_base (154)..(154): a, c, t, g, unknown or other
  misc_feature (154)..(154): n is a, c, g, or t

SEQ ID NO: 282142 - DNA, 154 bp, Homo sapiens; identical to SEQ ID NO: 281552
  misc_feature: GYAE6OF01CMAUH.1.24.C02.1.454.CMB.1.raw
  modified_base (154)..(154): a, c, t, g, unknown or other
  misc_feature (154)..(154): n is a, c, g, or t

SEQ ID NO: 282143 - DNA, 155 bp, Homo sapiens; identical to SEQ ID NO: 281555
  misc_feature: GYAE6OF01DITBI.1.24.C02.1.454.CMB.1.raw
  modified_base (154)..(155): a, c, t, g, unknown or other
  misc_feature (154)..(155): n is a, c, g, or t

SEQ ID NO: 282144 - DNA, 156 bp, Homo sapiens
  misc_feature: GYAE6OF01C3S8A.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgcactcgtctgagcgggctggcaaggcgcatagnnn

SEQ ID NO: 282145 - DNA, 153 bp, Homo sapiens
  misc_feature: GYAE6OF01EOAIA.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaataggtactctgagcgggctggcaaggcgcatagn

SEQ ID NO: 282146 - DNA, 191 bp, Homo sapiens
  misc_feature: GYAE6OF01EV9RI.1.24.C02.1.454.CMB.1.raw
  modified_base (157)..(191): a, c, t, g, unknown or other
  misc_feature (157)..(191): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatcctgaatagcgtactctgaggcgggctggcaaggcgcatagnnnnnnnnnnnnnnnnnnnnnnnnnnnnnnnnnnn

SEQ ID NO: 282147 - DNA, 154 bp, Homo sapiens; identical to SEQ ID NO: 281552
  misc_feature: GYAE6OF01DNEYG.1.24.C02.1.454.CMB.1.raw
  modified_base (154)..(154): a, c, t, g, unknown or other
  misc_feature (154)..(154): n is a, c, g, or t

SEQ ID NO: 282148 - DNA, 153 bp, Homo sapiens; identical to SEQ ID NO: 282002
  misc_feature: GYAE6OF01A5ETN.1.24.C02.1.454.CMB.1.raw

SEQ ID NO: 282149 - DNA, 156 bp, Homo sapiens; identical to SEQ ID NO: 281661
  misc_feature: GYAE6OF01C1SF8.1.24.C02.1.454.CMB.1.raw
  modified_base (154)..(156): a, c, t, g, unknown or other
  misc_feature (154)..(156): n is a, c, g, or t

SEQ ID NO: 282150 - DNA, 153 bp, Homo sapiens
  misc_feature: GYAE6OF01C92QS.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcatag

SEQ ID NO: 282151 - DNA, 158 bp, Homo sapiens
  misc_feature: GYAE6OF01CMAUN.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnnn

SEQ ID NO: 282152 - DNA, 162 bp, Homo sapiens; identical to SEQ ID NO: 281628
  misc_feature: GYAE6OF01BQTCH.1.24.C02.1.454.CMB.1.raw
  modified_base (154)..(162): a, c, t, g, unknown or other
  misc_feature (154)..(162): n is a, c, g, or t

SEQ ID NO: 282153 - DNA, 175 bp, Homo sapiens
  misc_feature: GYAE6OF01CPRFP.1.24.C02.1.454.CMB.1.raw
  modified_base (156)..(175): a, c, t, g, unknown or other
  misc_feature (156)..(175): n is a, c, g, or t
tcagacgagtgcgtcacgaccggtgctcgatttagtacagatcgttagggcgaagggaccaaggtgtagatcaaacgaactgtggctgcaccatctgtccttcatcttcccgccatctgaatagcgtactctgagcgggctggcaaggcgcatagnnnnnnnnnnnnnnnnnnnn

SEQ ID NO: 282154 - DNA, 155 bp, Homo sapiens; identical to SEQ ID NO: 281693
  misc_feature: GYAE6OF01DAZO4.1.24.C02.1.454.CMB.1.raw
  modified_base (154)..(155): a, c, t, g, unknown or other
  misc_feature (154)..(155): n is a, c, g, or t

SEQ ID NO: 282155 - DNA, 153 bp, Homo sapiens
  misc_feature: GYAE6OF01BZAHS.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatag

SEQ ID NO: 282156 - DNA, 156 bp, Homo sapiens; identical to SEQ ID NO: 281566
  misc_feature: GYAE6OF01DFRIB.1.24.C02.1.454.CMB.1.raw
  modified_base (154)..(156): a, c, t, g, unknown or other
  misc_feature (154)..(156): n is a, c, g, or t

SEQ ID NO: 282157 - DNA, 155 bp, Homo sapiens; identical to SEQ ID NO: 281799
  misc_feature: GYAE6OF01ASE16.1.24.C02.1.454.CMB.1.raw
  modified_base (154)..(155): a, c, t, g, unknown or other
  misc_feature (154)..(155): n is a, c, g, or t

SEQ ID NO: 282158 - DNA, 155 bp, Homo sapiens; identical to SEQ ID NO: 281555
  misc_feature: GYAE6OF01CS05P.1.24.C02.1.454.CMB.1.raw
  modified_base (154)..(155): a, c, t, g, unknown or other
  misc_feature (154)..(155): n is a, c, g, or t

SEQ ID NO: 282159 - DNA, 164 bp, Homo sapiens
  misc_feature: GYAE6OF01DNXJO.1.24.C02.1.454.CMB.1.raw
  modified_base (157)..(164): a, c, t, g, unknown or other
  misc_feature (157)..(164): n is a, c, g, or t
tcagacgagtgcgtcacgaccggtgctcgatttagtacagatcgttagggcgaagggaccaaggtggagatctaaacgaactgtggctgcaccatctgtcttcatcttcccgccatctgaatagcgtactctgagcgggctggcaaggtcgcatagnnnnnnnn

SEQ ID NO: 282160 - DNA, 154 bp, Homo sapiens; identical to SEQ ID NO: 281552
  misc_feature: GYAE6OF01AU0WY.1.24.C02.1.454.CMB.1.raw
  modified_base (154)..(154): a, c, t, g, unknown or other
  misc_feature (154)..(154): n is a, c, g, or t

SEQ ID NO: 282161 - DNA, 191 bp, Homo sapiens
  misc_feature: GYAE6OF01EXQ2B.1.24.C02.1.454.CMB.1.raw
  modified_base (162)..(191): a, c, t, g, unknown or other
  misc_feature (162)..(191): n is a, c, g, or t
tcagacgagtgcgtcacgaccggtgctcgattttagtacagatcgttagggcgtaagggggaccaaggtggagatcaaacgaactggtggctgcaccatctgtcttcatcttcccgcccatctgaatagcgtactctgagcgggctgggcaaggcgcatagnnnnnnnnnnnnnnnnnnnnnnnnnnnnnn

SEQ ID NO: 282162 - DNA, 176 bp, Homo sapiens
  misc_feature: GYAE6OF01EQKEQ.1.24.C02.1.454.CMB.1.raw
  modified_base (157)..(176): a, c, t, g, unknown or other
  misc_feature (157)..(176): n is a, c, g, or t
tcagacgagtgcgtcacgaccggtgctcgatttagtacagatcgttagggcgaagggaccaaaggtggagatcaaacgaactgtggctgcaccatactgtcttcatcttcccgccatctgaatagcgtactctgagcgggctggcaaggcgcatagnnnnnnnnnnnnnnnnnnnn

SEQ ID NO: 282163 - DNA, 154 bp, Homo sapiens; identical to SEQ ID NO: 281609
  misc_feature: GYAE6OF01DO4SC.1.24.C02.1.454.CMB.1.raw
  modified_base (154)..(154): a, c, t, g, unknown or other
  misc_feature (154)..(154): n is a, c, g, or t

SEQ ID NO: 282164 - DNA, 156 bp, Homo sapiens; identical to SEQ ID NO: 281595
  misc_feature: GYAE6OF01AGHIL.1.24.C02.1.454.CMB.1.raw
  modified_base (154)..(156): a, c, t, g, unknown or other
  misc_feature (154)..(156): n is a, c, g, or t

SEQ ID NO: 282165 - DNA, 153 bp, Homo sapiens; identical to SEQ ID NO: 282002
  misc_feature: GYAE6OF01AR6TJ.1.24.C02.1.454.CMB.1.raw

SEQ ID NO: 282166 - DNA, 155 bp, Homo sapiens; identical to SEQ ID NO: 282007
  misc_feature: GYAE6OF01AL0O9.1.24.C02.1.454.CMB.1.raw
  modified_base (154)..(155): a, c, t, g, unknown or other
  misc_feature (154)..(155): n is a, c, g, or t

SEQ ID NO: 282167 - DNA, 154 bp, Homo sapiens; identical to SEQ ID NO: 281569
  misc_feature: GYAE6OF01AJTS1.1.24.C02.1.454.CMB.1.raw
  modified_base (154)..(154): a, c, t, g, unknown or other
  misc_feature (154)..(154): n is a, c, g, or t

SEQ ID NO: 282168 - DNA, 183 bp, Homo sapiens
  misc_feature: GYAE6OF01CX53L.1.24.C02.1.454.CMB.1.raw
  modified_base (156)..(183): a, c, t, g, unknown or other
  misc_feature (156)..(183): n is a, c, g, or t
tcagacgagtgcgtcacgaccggtgctcgatttagtacagatcgttagggcaaggggaccaaggtgtagatcaaacgaactgtggctgcaccatctgtcttcatcttcccgccatctgaatagcgtactctggagcgggctggcaaggcgcatagnnnnnnnnnnnnnnnnnnnnnnnnnnnn

SEQ ID NO: 282169 - DNA, 155 bp, Homo sapiens; identical to SEQ ID NO: 281555
  misc_feature: GYAE6OF01CUECA.1.24.C02.1.454.CMB.1.raw
  modified_base (154)..(155): a, c, t, g, unknown or other
  misc_feature (154)..(155): n is a, c, g, or t

SEQ ID NO: 282170 - DNA, 155 bp, Homo sapiens
  misc_feature: GYAE6OF01BRMQP.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccaccctcctcacgtagcgtgctgagcgggctggcaaggcgcatagnn

SEQ ID NO: 282171 - DNA, 154 bp, Homo sapiens; identical to SEQ ID NO: 281552
  misc_feature: GYAE6OF01D9N3A.1.24.C02.1.454.CMB.1.raw
  modified_base (154)..(154): a, c, t, g, unknown or other
  misc_feature (154)..(154): n is a, c, g, or t

SEQ ID NO: 282172 - DNA, 217 bp, Homo sapiens
  misc_feature: GYAE6OF01EH9UF.1.24.C02.1.454.CMB.1.raw
  modified_base (170)..(217): a, c, t, g, unknown or other
  misc_feature (170)..(217): n is a, c, g, or t
tcagacgagtgcgtcacgaccggtgctcgatttagtacagatcgttagggcgtaaggggaccaaaggtggagatcaaacgaactgtggcctgcgacccatctacgtcttcatcttcccgccatcctgaatagcgtactcgtgacgcgggacctgggcaagggcgcatagnnnnnnnnnnnnnnnnnnnnnnnnnnnnnnnnnnnnnnnnnnnnnnnn

SEQ ID NO: 282173 - DNA, 208 bp, Homo sapiens
  misc_feature: GYAE6OF01ENLGJ.1.24.C02.1.454.CMB.1.raw
  modified_base (159)..(208): a, c, t, g, unknown or other
  misc_feature (159)..(208): n is a, c, g, or t
tcagacgagtgcgtcacgaccggtgctcgatttagtacagatcgttagggaaggggaccaaggtggagatcaaacgaactgtggctgcaccatctgtcttcagtcttcccgccctccttcacgccactcgtctgagcgggctggctaaggcgcattagnnnnnnnnnnnnnnnnnnnnnnnnnnnnnnnnnnnnnnnnnnnnnnnnnn

SEQ ID NO: 282174 - DNA, 167 bp, Homo sapiens
  misc_feature: GYAE6OF01EQNIC.1.24.C02.1.454.CMB.1.raw
  modified_base (155)..(167): a, c, t, g, unknown or other
  misc_feature (155)..(167): n is a, c, g, or t
tcagacgagtgcgtcacgaccggtgctcgatttagtacagatcgttagggaaagggaccaaaggtggagatcaaacgaactgtggctgcaccatctgtcttcatcttcccgccatctgaatagcgtactctgagcgggctggcaaggcgcatagnnnnnnnnnnnnn

SEQ ID NO: 282175 - DNA, 154 bp, Homo sapiens; identical to SEQ ID NO: 281552
  misc_feature: GYAE6OF01DA3PG.1.24.C02.1.454.CMB.1.raw
  modified_base (154)..(154): a, c, t, g, unknown or other
  misc_feature (154)..(154): n is a, c, g, or t

SEQ ID NO: 282176 - DNA, 156 bp, Homo sapiens
  misc_feature: GYAE6OF01BTWHS.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagnnn

SEQ ID NO: 282177 - DNA, 155 bp, Homo sapiens; identical to SEQ ID NO: 281575
  misc_feature: GYAE6OF01B65V5.1.24.C02.1.454.CMB.1.raw
  modified_base (154)..(155): a, c, t, g, unknown or other
  misc_feature (154)..(155): n is a, c, g, or t

SEQ ID NO: 282178 - DNA, 155 bp, Homo sapiens
  misc_feature: GYAE6OF01AJ3N0.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgtctactgctgagcgggctggcaaggcgcatagnn

SEQ ID NO: 282179 - DNA, 156 bp, Homo sapiens; identical to SEQ ID NO: 281741
  misc_feature: GYAE6OF01B16ZD.1.24.C02.1.454.CMB.1.raw
  modified_base (154)..(156): a, c, t, g, unknown or other
  misc_feature (154)..(156): n is a, c, g, or t

SEQ ID NO: 282180 - DNA, 192 bp, Homo sapiens
  misc_feature: GYAE6OF01BEQ4I.1.24.C02.1.454.CMB.1.raw
  modified_base (160)..(192): a, c, t, g, unknown or other
  misc_feature (160)..(192): n is a, c, g, or t
tcagacgagtgcgtcacgaccggtgctcgatttagtacagatcgttagggcgtaaggggaccaaggtggagatcaaacgaactgtggctgcacccatctgtcttcatcttcccgccatctgaatagcgtacctctgagcgggctggacaaggcgcatagnnnnnnnnnnnnnnnnnnnnnnnnnnnnnnnnn

SEQ ID NO: 282181 - DNA, 171 bp, Homo sapiens
  misc_feature: GYAE6OF01BBWK7.1.24.C02.1.454.CMB.1.raw
  modified_base (159)..(171): a, c, t, g, unknown or other
  misc_feature (159)..(171): n is a, c, g, or t
tcagacgagtgcgtcacgaccggtgctcgatttagtacagatcgttagggctaaggggaccaaggtggagatcaaacgaactgtggctgtaaccatctgtcttcatcttcccgccatctgaatagcgtactctgagtcgggctggcaaggcgtcatagnnnnnnnnnnnnn

SEQ ID NO: 282182 - DNA, 154 bp, Homo sapiens; identical to SEQ ID NO: 281641
  misc_feature: GYAE6OF01BY9U0.1.24.C02.1.454.CMB.1.raw
  modified_base (154)..(154): a, c, t, g, unknown or other
  misc_feature (154)..(154): n is a, c, g, or t

SEQ ID NO: 282183 - DNA, 154 bp, Homo sapiens; identical to SEQ ID NO: 281998
  misc_feature: GYAE6OF01CIVD6.1.24.C02.1.454.CMB.1.raw
  modified_base (154)..(154): a, c, t, g, unknown or other
  misc_feature (154)..(154): n is a, c, g, or t

SEQ ID NO: 282184 - DNA, 154 bp, Homo sapiens; identical to SEQ ID NO: 281998
  misc_feature: GYAE6OF01CEHZD.1.24.C02.1.454.CMB.1.raw
  modified_base (154)..(154): a, c, t, g, unknown or other
  misc_feature (154)..(154): n is a, c, g, or t

SEQ ID NO: 282185 - DNA, 155 bp, Homo sapiens; identical to SEQ ID NO: 281978
  misc_feature: GYAE6OF01DC3O8.1.24.C02.1.454.CMB.1.raw
  modified_base (154)..(155): a, c, t, g, unknown or other
  misc_feature (154)..(155): n is a, c, g, or t

SEQ ID NO: 282186 - DNA, 156 bp, Homo sapiens
  misc_feature: GYAE6OF01A4J90.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgcctcctcacgcactcgtctgagcgggctggcaaggcgcatagnnnn

SEQ ID NO: 282187 - DNA, 155 bp, Homo sapiens; identical to SEQ ID NO: 281555
  misc_feature: GYAE6OF01EESQM.1.24.C02.1.454.CMB.1.raw
  modified_base (154)..(155): a, c, t, g, unknown or other
  misc_feature (154)..(155): n is a, c, g, or t

SEQ ID NO: 282188 - DNA, 155 bp, Homo sapiens; identical to SEQ ID NO: 281799
  misc_feature: GYAE6OF01C4DGN.1.24.C02.1.454.CMB.1.raw
  modified_base (154)..(155): a, c, t, g, unknown or other
  misc_feature (154)..(155): n is a, c, g, or t

SEQ ID NO: 282189 - DNA, 154 bp, Homo sapiens; identical to SEQ ID NO: 281604
  misc_feature: GYAE6OF01AY7HO.1.24.C02.1.454.CMB.1.raw
  modified_base (154)..(154): a, c, t, g, unknown or other
  misc_feature (154)..(154): n is a, c, g, or t

SEQ ID NO: 282190 - DNA, 161 bp, Homo sapiens
  misc_feature: GYAE6OF01EMCED.1.24.C02.1.454.CMB.1.raw
  modified_base (154)..(161): a, c, t, g, unknown or other
  misc_feature (154)..(161): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgatatgtatactctgagcgggctggcaaggcgcatagnnnnnnnn

SEQ ID NO: 282191 - DNA, 157 bp, Homo sapiens
  misc_feature: GYAE6OF01CI9S3.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtggagatcaaacgaactgtggctgcaccatctgtcttcatcttctcaccctcctcacgtagcgtgctgagcgggctggcaaggcgcatagnnnn

SEQ ID NO: 282192 - DNA, 172 bp, Homo sapiens
  misc_feature: GYAE6OF01B7EC6.1.24.C02.1.454.CMB.1.raw
  modified_base (155)..(172): a, c, t, g, unknown or other
  misc_feature (155)..(172): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgatatgtatactctgagcgggctggcaaggcgcatagnnnnnnnnnnnnnnnnnn

SEQ ID NO: 282193 - DNA, 153 bp, Homo sapiens; identical to SEQ ID NO: 281596
  misc_feature: GYAE6OF01BJZMQ.1.24.C02.1.454.CMB.1.raw
  modified_base (153)..(153): a, c, t, g, unknown or other
  misc_feature (153)..(153): n is a, c, g, or t

SEQ ID NO: 282194 - DNA, 154 bp, Homo sapiens; identical to SEQ ID NO: 281641
  misc_feature: GYAE6OF01BH6HY.1.24.C02.1.454.CMB.1.raw
  modified_base (154)..(154): a, c, t, g, unknown or other
  misc_feature (154)..(154): n is a, c, g, or t

SEQ ID NO: 282195 - DNA, 157 bp, Homo sapiens; identical to SEQ ID NO: 281964
  misc_feature: GYAE6OF01B7V43.1.24.C02.1.454.CMB.1.raw
  modified_base (154)..(157): a, c, t, g, unknown or other
  misc_feature (154)..(157): n is a, c, g, or t

SEQ ID NO: 282196 - DNA, 154 bp, Homo sapiens; identical to SEQ ID NO: 281552
  misc_feature: GYAE6OF01DS61M.1.24.C02.1.454.CMB.1.raw
  modified_base (154)..(154): a, c, t, g, unknown or other
  misc_feature (154)..(154): n is a, c, g, or t

SEQ ID NO: 282197 - DNA, 175 bp, Homo sapiens
  misc_feature: GYAE6OF01EUBFS.1.24.C02.1.454.CMB.1.raw
  modified_base (150)..(150): a, c, t, g, unknown or other
  misc_feature (150)..(150): n is a, c, g, or t
  modified_base (156)..(175): a, c, t, g, unknown or other
  misc_feature (156)..(175): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgatatgtatactctgagcgggctggcaagggcncatagnnnnnnnnnnnnnnnnnnnn

SEQ ID NO: 282198 - DNA, 154 bp, Homo sapiens; identical to SEQ ID NO: 281569
  misc_feature: GYAE6OF01DDZU8.1.24.C02.1.454.CMB.1.raw
  modified_base (154)..(154): a, c, t, g, unknown or other
  misc_feature (154)..(154): n is a, c, g, or t

SEQ ID NO: 282199 - DNA, 154 bp, Homo sapiens; identical to SEQ ID NO: 281552
  misc_feature: GYAE6OF01CZ5LT.1.24.C02.1.454.CMB.1.raw
  modified_base (154)..(154): a, c, t, g, unknown or other
  misc_feature (154)..(154): n is a, c, g, or t

SEQ ID NO: 282200 - DNA, 165 bp, Homo sapiens
  misc_feature: GYAE6OF01BJP1U.1.24.C02.1.454.CMB.1.raw
  modified_base (154)..(165): a, c, t, g, unknown or other
  misc_feature (154)..(165): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnnn

SEQ ID NO: 282201 - DNA, 154 bp, Homo sapiens; identical to SEQ ID NO: 281614
  misc_feature: GYAE6OF01D985T.1.24.C02.1.454.CMB.1.raw
  modified_base (154)..(154): a, c, t, g, unknown or other
  misc_feature (154)..(154): n is a, c, g, or t

SEQ ID NO: 282202 - DNA, 184 bp, Homo sapiens
  misc_feature: GYAE6OF01ET4XN.1.24.C02.1.454.CMB.1.raw
  modified_base (152)..(152): a, c, t, g, unknown or other
  misc_feature (152)..(152): n is a, c, g, or t
  modified_base (157)..(184): a, c, t, g, unknown or other
  misc_feature (157)..(184): n is a, c, g, or t
tcagacgagtgcgtcacgaccggtgctcgatttagtacagatcgttagggacgaaaggggaccaaggtggagatcaaacgaactgtggctgcaccatctgtcttcatcctcccgccatctgatagcgtattctgagcgggctggcaaggcgnatagnnnnnnnnnnnnnnnnnnnnnnnnnnnn

SEQ ID NO: 282203 - DNA, 172 bp, Homo sapiens
  misc_feature: GYAE6OF01BFE8C.1.24.C02.1.454.CMB.1.raw
  modified_base (157)..(172): a, c, t, g, unknown or other
  misc_feature (157)..(172): n is a, c, g, or t
tcagacgagtgcgtcacgaccggtgctcgatttagtacagatcgttagggaaaggggaccaaaggtggagatcaaacgaactgtggctgcaccactctgtcttcatcttcccgccatctgatatgtatactctgagcgggctggcaaggcgcatagnnnnnnnnnnnnnnnn

SEQ ID NO: 282204 - DNA, 154 bp, Homo sapiens; identical to SEQ ID NO: 281552
  misc_feature: GYAE6OF01ECC09.1.24.C02.1.454.CMB.1.raw
  modified_base (154)..(154): a, c, t, g, unknown or other
  misc_feature (154)..(154): n is a, c, g, or t

SEQ ID NO: 282205 - DNA, 157 bp, Homo sapiens
  misc_feature: GYAE6OF01CPQ5F.1.24.C02.1.454.CMB.1.raw
  modified_base (148)..(148): a, c, t, g, unknown or other
  misc_feature (148)..(148): n is a, c, g, or t
  modified_base (153)..(157): a, c, t, g, unknown or other
  misc_feature (153)..(157): n is a, c, g, or t
tcagacgagtgcgtcacgaccggtgctcgatttagtacagatcgttagggcaagggaccaaggtggagatcaaaacgtaactgtggctgcaccatctgtcttcatcttccgcatctgaatagcgtactgtgagcgggctggcaaggcnatagnnnnn

SEQ ID NO: 282206 - DNA, 154 bp, Homo sapiens; identical to SEQ ID NO: 281552
  misc_feature: GYAE6OF01BHE3P.1.24.C02.1.454.CMB.1.raw
  modified_base (154)..(154): a, c, t, g, unknown or other
  misc_feature (154)..(154): n is a, c, g, or t

SEQ ID NO: 282207 - DNA, 154 bp, Homo sapiens; identical to SEQ ID NO: 281609
  misc_feature: GYAE6OF01DWL4W.1.24.C02.1.454.CMB.1.raw
  modified_base (154)..(154): a, c, t, g, unknown or other
  misc_feature (154)..(154): n is a, c, g, or t

SEQ ID NO: 282208 - DNA, 155 bp, Homo sapiens; identical to SEQ ID NO: 281555
  misc_feature: GYAE6OF01EMLMQ.1.24.C02.1.454.CMB.1.raw
  modified_base (154)..(155): a, c, t, g, unknown or other
  misc_feature (154)..(155): n is a, c, g, or t

SEQ ID NO: 282209 - DNA, 157 bp, Homo sapiens
  misc_feature: GYAE6OF01DN9DA.1.24.C02.1.454.CMB.1.raw
  modified_base (148)..(148): a, c, t, g, unknown or other
  misc_feature (148)..(148): n is a, c, g, or t
  modified_base (154)..(157): a, c, t, g, unknown or other
  misc_feature (154)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcncatagnnnn

SEQ ID NO: 282210 - DNA, 154 bp, Homo sapiens; identical to SEQ ID NO: 281572
  misc_feature: GYAE6OF01AE88U.1.24.C02.1.454.CMB.1.raw
  modified_base (154)..(154): a, c, t, g, unknown or other
  misc_feature (154)..(154): n is a, c, g, or t

SEQ ID NO: 282211 - DNA, 154 bp, Homo sapiens; identical to SEQ ID NO: 281609
  misc_feature: GYAE6OF01AY6WS.1.24.C02.1.454.CMB.1.raw
  modified_base (154)..(154): a, c, t, g, unknown or other
  misc_feature (154)..(154): n is a, c, g, or t

SEQ ID NO: 282212 - DNA, 154 bp, Homo sapiens; identical to SEQ ID NO: 281552
  misc_feature: GYAE6OF01DIN08.1.24.C02.1.454.CMB.1.raw
  modified_base (154)..(154): a, c, t, g, unknown or other
  misc_feature (154)..(154): n is a, c, g, or t

SEQ ID NO: 282213 - DNA, 154 bp, Homo sapiens
  misc_feature: GYAE6OF01DW9T5.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggatatcaaacgaactgtggctgcaccatctgtcttcatcttcccgccatctgatatgtatactctgagcgggctggcaaggcgcatagn

SEQ ID NO: 282214 - DNA, 156 bp, Homo sapiens; identical to SEQ ID NO: 281661
  misc_feature: GYAE6OF01D6M5F.1.24.C02.1.454.CMB.1.raw
  modified_base (154)..(156): a, c, t, g, unknown or other
  misc_feature (154)..(156): n is a, c, g, or t

SEQ ID NO: 282215 - DNA, 159 bp, Homo sapiens; identical to SEQ ID NO: 282060
  misc_feature: GYAE6OF01BY7TF.1.24.C02.1.454.CMB.1.raw
  modified_base (154)..(159): a, c, t, g, unknown or other
  misc_feature (154)..(159): n is a, c, g, or t

SEQ ID NO: 282216 - DNA, 234 bp, Homo sapiens
  misc_feature: GYAE6OF01D7OM1.1.24.C02.1.454.CMB.1.raw
  modified_base (164)..(165): a, c, t, g, unknown or other
  misc_feature (164)..(165): n is a, c, g, or t
  modified_base (167)..(234): a, c, t, g, unknown or other
  misc_feature (167)..(234): n is a, c, g, or t
tcagacgagtgcgtcacgaccggtgctcgatttagtacagatcgttagggcgtaaggggaccaaggtggagagtcaaacgaactgtggctgcaccagtcctgtcttcatcttcccggccatctgactcgtctctacgtggagcgggctggcaaggcgcatagcnncnnnnnnnnnnnnnnnnnnnnnnnnnnnnnnnnnnnnnnnnnnnnnnnnnnnnnnnnnnnnnnnnnnnn

SEQ ID NO: 282217 - DNA, 154 bp, Homo sapiens
  misc_feature: GYAE6OF01AWPF4.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgagagtgcgtctctgagcgggctggcaaggcgcatagn

SEQ ID NO: 282218 - DNA, 159 bp, Homo sapiens; identical to SEQ ID NO: 281682
  misc_feature: GYAE6OF01EKTYJ.1.24.C02.1.454.CMB.1.raw
  modified_base (154)..(159): a, c, t, g, unknown or other
  misc_feature (154)..(159): n is a, c, g, or t

SEQ ID NO: 282219 - DNA, 155 bp, Homo sapiens; identical to SEQ ID NO: 281555
  misc_feature: GYAE6OF01EXARZ.1.24.C02.1.454.CMB.1.raw
  modified_base (154)..(155): a, c, t, g, unknown or other
  misc_feature (154)..(155): n is a, c, g, or t

SEQ ID NO: 282220 - DNA, 154 bp, Homo sapiens; identical to SEQ ID NO: 281607
  misc_feature: GYAE6OF01CHHLF.1.24.C02.1.454.CMB.1.raw
  modified_base (154)..(154): a, c, t, g, unknown or other
  misc_feature (154)..(154): n is a, c, g, or t

SEQ ID NO: 282221 - DNA, 154 bp, Homo sapiens; identical to SEQ ID NO: 281552
  misc_feature: GYAE6OF01A6HDM.1.24.C02.1.454.CMB.1.raw
  modified_base (154)..(154): a, c, t, g, unknown or other
  misc_feature (154)..(154): n is a, c, g, or t

SEQ ID NO: 282222 - DNA, 156 bp, Homo sapiens
  misc_feature: GYAE6OF01DPIHR.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaagtcgctagactgagcgggctggcaaggcgcatagnnn

SEQ ID NO: 282223 - DNA, 154 bp, Homo sapiens; identical to SEQ ID NO: 281552
  misc_feature: GYAE6OF01CFX2A.1.24.C02.1.454.CMB.1.raw
  modified_base (154)..(154): a, c, t, g, unknown or other
  misc_feature (154)..(154): n is a, c, g, or t

SEQ ID NO: 282224 - DNA, 169 bp, Homo sapiens
  misc_feature: GYAE6OF01AX5G1.1.24.C02.1.454.CMB.1.raw
  modified_base (155)..(169): a, c, t, g, unknown or other
  misc_feature (155)..(169): n is a, c, g, or t
tcagacgagtgcgtcacgaccggtgctcgatttagtacagatcgttaggggaaagggaacaaggtggagatcaaacgaactgtggctgcaccatctgtcttcatcttcccgccatctgaacgtctactgctgagcgggctggcaaggcgcatagnnnnnnnnnnnnnnn

SEQ ID NO: 282225 - DNA, 156 bp, Homo sapiens
  misc_feature: GYAE6OF01DJSAK.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcggctggcaaggcgcatagnnnn

SEQ ID NO: 282226 - DNA, 153 bp, Homo sapiens
  misc_feature: GYAE6OF01CYTDG.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatag

SEQ ID NO: 282227 - DNA, 166 bp, Homo sapiens; identical to SEQ ID NO: 281635
  misc_feature: GYAE6OF01CYY0L.1.24.C02.1.454.CMB.1.raw
  modified_base (155)..(166): a, c, t, g, unknown or other
  misc_feature (155)..(166): n is a, c, g, or t

SEQ ID NO: 282228 - DNA, 204 bp, Homo sapiens
  misc_feature: GYAE6OF01BFCIU.1.24.C02.1.454.CMB.1.raw
  modified_base (161)..(204): a, c, t, g, unknown or other
  misc_feature (161)..(204): n is a, c, g, or t
tcagacgagtgcgtcacgaccggtgctcgatttagtacagatcgttaagggcaagggaccaaggtggagattcaaacgaactgtggcgtgcaccatctgtcttcatcttcccggccaatccgtgaatagcgtactctgagcgggctggcaaggcgcatagnnnnnnnnnnnnnnnnnnnnnnnnnnnnnnnnnnnnnnnnnnnn

SEQ ID NO: 282229 - DNA, 157 bp, Homo sapiens
  misc_feature: GYAE6OF01EOUIY.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtggagatcaaacgaactgtggctgcaccatctgtcttcatcttcccgccctcctcacgtagcgtgctgagcgggctggcaaggcgcatagnnnn

SEQ ID NO: 282230 - DNA, 155 bp, Homo sapiens; identical to SEQ ID NO: 281739
  misc_feature: GYAE6OF01EZW6E.1.24.C02.1.454.CMB.1.raw
  modified_base (154)..(155): a, c, t, g, unknown or other
  misc_feature (154)..(155): n is a, c, g, or t

SEQ ID NO: 282231 - DNA, 193 bp, Homo sapiens
  misc_feature: GYAE6OF01A8LZH.1.24.C02.1.454.CMB.1.raw
  modified_base (160)..(193): a, c, t, g, unknown or other
  misc_feature (160)..(193): n is a, c, g, or t
tcagacgagtgcgtcacgaccggtgctcgatttagtacagatcgtttaggggtcgaagggaccaaaggtggagatcaaacgaactgtggctagcaccatctgtcttcatcttcccgccatctgaatagcgtactctgagcgggctggcaaggcgcatagnnnnnnnnnnnnnnnnnnnnnnnnnnnnnnnnnn

SEQ ID NO: 282232 - DNA, 201 bp, Homo sapiens
  misc_feature: GYAE6OF01BOBN3.1.24.C02.1.454.CMB.1.raw
  modified_base (161)..(201): a, c, t, g, unknown or other
  misc_feature (161)..(201): n is a, c, g, or t
tcagacgagtgcgtcacgaccggtgctcgatttagtacagatcgttagggctaaggggacccaaggtggagatccaaacgaactgtggcctgcaccatctgtcttcatcttcccgccatctgaatagcgttactctgagcgggctggcaagggcgcatagnnnnnnnnnnnnnnnnnnnnnnnnnnnnnnnnnnnnnnnnn

SEQ ID NO: 282233 - DNA, 295 bp, Homo sapiens
  misc_feature: GYAE6OF01EU7HV.1.24.C02.1.454.CMB.1.raw
  modified_base (289)..(295): a, c, t, g, unknown or other
  misc_feature (289)..(295): n is a, c, g, or t
tcagacgagtgcgtcacgaccggtgctcgatttagtacagatcgttcgagggaatccggggtccctgaccgattcagtggcagcgggtctgggacagatttcactctcaccatcagcagcctgcagcctgaagattttgcaacttattactgtcaacagcttaatagttacccttacacttttggccaggggaccaagctggagatcaaacgaactgtggctgcaccatctgtcttcatcttcccgcatctgaacgcactcgtctgagcgggctggcaaggcgcatagnnnnnnn

SEQ ID NO: 282234 - DNA, 162 bp, Homo sapiens
  misc_feature: GYAE6OF01AVHWY.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgtctactgctgagcgggctggcaaggcgcatagnnnnnnnnn

SEQ ID NO: 282235 - DNA, 156 bp, Homo sapiens; identical to SEQ ID NO: 281741
  misc_feature: GYAE6OF01BPFB9.1.24.C02.1.454.CMB.1.raw
  modified_base (154)..(156): a, c, t, g, unknown or other
  misc_feature (154)..(156): n is a, c, g, or t

SEQ ID NO: 282236 - DNA, 157 bp, Homo sapiens; identical to SEQ ID NO: 281599
  misc_feature: GYAE6OF01DL9MW.1.24.C02.1.454.CMB.1.raw
  modified_base (154)..(157): a, c, t, g, unknown or other
  misc_feature (154)..(157): n is a, c, g, or t

SEQ ID NO: 282237 - DNA, 155 bp, Homo sapiens; identical to SEQ ID NO: 281865
  misc_feature: GYAE6OF01E25VF.1.24.C02.1.454.CMB.1.raw
  modified_base (154)..(155): a, c, t, g, unknown or other
  misc_feature (154)..(155): n is a, c, g, or t

SEQ ID NO: 282238 - DNA, 155 bp, Homo sapiens; identical to SEQ ID NO: 281931
  misc_feature: GYAE6OF01ELCNB.1.24.C02.1.454.CMB.1.raw
  modified_base (154)..(155): a, c, t, g, unknown or other
  misc_feature (154)..(155): n is a, c, g, or t

SEQ ID NO: 282239 - DNA, 154 bp, Homo sapiens; identical to SEQ ID NO: 281552
  misc_feature: GYAE6OF01BMBMT.1.24.C02.1.454.CMB.1.raw
  modified_base (154)..(154): a, c, t, g, unknown or other
  misc_feature (154)..(154): n is a, c, g, or t

SEQ ID NO: 282240 - DNA, 155 bp, Homo sapiens; identical to SEQ ID NO: 281764
  misc_feature: GYAE6OF01B7YRK.1.24.C02.1.454.CMB.1.raw
  modified_base (154)..(155): a, c, t, g, unknown or other
  misc_feature (154)..(155): n is a, c, g, or t

SEQ ID NO: 282241 - DNA, 178 bp, Homo sapiens
  misc_feature: GYAE6OF01EGIGA.1.24.C02.1.454.CMB.1.raw
  modified_base (157)..(178): a, c, t, g, unknown or other
  misc_feature (157)..(178): n is a, c, g, or t
tcagacgagtgcgtcacgaccggtgctcgatttagtacagatcgttagggcaaggggaccaaggtggaaatcaaacgaactgtggctgcaccatctgtcttcatcttcccgccatctgaatagcgtactctgagcggggctgggcaaggcgcatagnnnnnnnnnnnnnnnnnnnnnn

SEQ ID NO: 282242 - DNA, 155 bp, Homo sapiens; identical to SEQ ID NO: 281697
  misc_feature: GYAE6OF01AOETQ.1.24.C02.1.454.CMB.1.raw
  modified_base (154)..(155): a, c, t, g, unknown or other
  misc_feature (154)..(155): n is a, c, g, or t

SEQ ID NO: 282243 - DNA, 157 bp, Homo sapiens
  misc_feature: GYAE6OF01E2K9P.1.24.C02.1.454.CMB.1.raw
  modified_base (148)..(148): a, c, t, g, unknown or other
  misc_feature (148)..(148): n is a, c, g, or t
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcncatagnnnn

SEQ ID NO: 282244 - DNA, 154 bp, Homo sapiens; identical to SEQ ID NO: 281607
  misc_feature: GYAE6OF01D5LTI.1.24.C02.1.454.CMB.1.raw
  modified_base (154)..(154): a, c, t, g, unknown or other
  misc_feature (154)..(154): n is a, c, g, or t

SEQ ID NO: 282245 - DNA, 154 bp, Homo sapiens
  misc_feature: GYAE6OF01BV2AX.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnn

SEQ ID NO: 282246 - DNA, 185 bp, Homo sapiens
  misc_feature: GYAE6OF01BJJ2R.1.24.C02.1.454.CMB.1.raw
  modified_base (156)..(156): a, c, t, g, unknown or other
  misc_feature (156)..(156): n is a, c, g, or t
  modified_base (158)..(185): a, c, t, g, unknown or other
  misc_feature (158)..(185): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaagggtcgcatagntnnnnnnnnnnnnnnnnnnnnnnnnnnnn

SEQ ID NO: 282247 - DNA, 154 bp, Homo sapiens; identical to SEQ ID NO: 281552
  misc_feature: GYAE6OF01AHDOP.1.24.C02.1.454.CMB.1.raw
  modified_base (154)..(154): a, c, t, g, unknown or other
  misc_feature (154)..(154): n is a, c, g, or t

SEQ ID NO: 282248 - DNA, 187 bp, Homo sapiens
  misc_feature: GYAE6OF01ECUFX.1.24.C02.1.454.CMB.1.raw
  modified_base (151)..(151): a, c, t, g, unknown or other
  misc_feature (151)..(151): n is a, c, g, or t
  modified_base (157)..(187): a, c, t, g, unknown or other
  misc_feature (157)..(187): n is a, c, g, or t
tcagacgagtgcgtcacgaccggtgctcgatttagtacagatcgttagggcgaagggaccaaggtggagatcaaacgaactgtggctgcaccatctgtcttcactcttcccgccatcctgaatagcgtactctgagcgggctggcaaggcncatagnnnnnnnnnnnnnnnnnnnnnnnnnnnnnnn

SEQ ID NO: 282249 - DNA, 159 bp, Homo sapiens; identical to SEQ ID NO: 281835
  misc_feature: GYAE6OF01ADVYS.1.24.C02.1.454.CMB.1.raw
  modified_base (154)..(159): a, c, t, g, unknown or other
  misc_feature (154)..(159): n is a, c, g, or t

SEQ ID NO: 282250 - DNA, 163 bp, Homo sapiens
  misc_feature: GYAE6OF01BWH2B.1.24.C02.1.454.CMB.1.raw
  modified_base (151)..(151): a, c, t, g, unknown or other
  misc_feature (151)..(151): n is a, c, g, or t
  modified_base (158)..(163): a, c, t, g, unknown or other
  misc_feature (158)..(163): n is a, c, g, or t
tcagacgagtgcgtcacgaccggtgctcgatttagtacagatcgttagggaaagggaccaaggtggagatcaaacgaactgtggctgcaccatctgtcttcatccttcccaccctctcacgtctactgctgaggcgggtctggacaaggcncagtagnnnnnn

SEQ ID NO: 282251 - DNA, 153 bp, Homo sapiens
  misc_feature: GYAE6OF01AV258.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcggatatctgagcgggctggcaaggcgcatagn

SEQ ID NO: 282252 - DNA, 154 bp, Homo sapiens; identical to SEQ ID NO: 281607
  misc_feature: GYAE6OF01BRA45.1.24.C02.1.454.CMB.1.raw
  modified_base (154)..(154): a, c, t, g, unknown or other
  misc_feature (154)..(154): n is a, c, g, or t

SEQ ID NO: 282253 - DNA, 156 bp, Homo sapiens; identical to SEQ ID NO: 281661
  misc_feature: GYAE6OF01ECE57.1.24.C02.1.454.CMB.1.raw
  modified_base (154)..(156): a, c, t, g, unknown or other
  misc_feature (154)..(156): n is a, c, g, or t

SEQ ID NO: 282254 - DNA, 154 bp, Homo sapiens; identical to SEQ ID NO: 281569
  misc_feature: GYAE6OF01AXHS7.1.24.C02.1.454.CMB.1.raw
  modified_base (154)..(154): a, c, t, g, unknown or other
  misc_feature (154)..(154): n is a, c, g, or t

SEQ ID NO: 282255 - DNA, 175 bp, Homo sapiens
  misc_feature: GYAE6OF01BRMK7.1.24.C02.1.454.CMB.1.raw
  modified_base (148)..(148): a, c, t, g, unknown or other
  misc_feature (148)..(148): n is a, c, g, or t
  modified_base (154)..(175): a, c, t, g, unknown or other
  misc_feature (154)..(175): n is a, c, g, or t
tcagacgagtgcgtcacgaccggtgctcgatttagtacagatcgttagggaaagggaccaaggtggagatcaaacgaactgtggctgcaccatctgtcttcatcttccgccatctgatatacgattcgctgagcgggctggcaaggcncatagnnnnnnnnnnnnnnnnnnnnnn

SEQ ID NO: 282256 - DNA, 152 bp, Homo sapiens
  misc_feature: GYAE6OF01EYTMA.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttaggcaagggaccaaggtggagatcaaacgaactgtggctgcaccatctgtcttcatcttcccgccatctgatagcgtactctgagcgggctggcaaggcgcatagn

SEQ ID NO: 282257 - DNA, 154 bp, Homo sapiens; identical to SEQ ID NO: 281641
  misc_feature: GYAE6OF01EY4UO.1.24.C02.1.454.CMB.1.raw
  modified_base (154)..(154): a, c, t, g, unknown or other
  misc_feature (154)..(154): n is a, c, g, or t

SEQ ID NO: 282258 - DNA, 154 bp, Homo sapiens; identical to SEQ ID NO: 281576
  misc_feature: GYAE6OF01EZT5P.1.24.C02.1.454.CMB.1.raw
  modified_base (154)..(154): a, c, t, g, unknown or other
  misc_feature (154)..(154): n is a, c, g, or t

SEQ ID NO: 282259 - DNA, 157 bp, Homo sapiens
  misc_feature: GYAE6OF01CBB9D.1.24.C02.1.454.CMB.1.raw
  modified_base (157)..(157): a, c, t, g, unknown or other
  misc_feature (157)..(157): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgaggcgggctgggcaaaggcgcatagn

SEQ ID NO: 282260 - DNA, 161 bp, Homo sapiens
  misc_feature: GYAE6OF01DG12M.1.24.C02.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacagatcgttagggaaagggaccaaggtggagatacaaacgaactgtggctgcaccatctgtcttcatcttcccgccatctgatactgctagtctgagcgggctggcaaggcgcatagnnnnnnn

SEQ ID NO: 282261 - DNA, 160 bp, Homo sapiens
  misc_feature: GYAE6OF01B2ATN.1.24.C02.1.454.CMB.1.raw
  modified_base (155)..(160): a, c, t, g, unknown or other
  misc_feature (155)..(160): n is a, c, g, or t
tcagacgagtgcgtcacgaccggtgctcgatttagtacagatcgttagggaaagtgaccaaggtggagatcaaactaactgtggctgcaccatctgtcttcatccttcccgccatctgatcgtactgcgctgagcgggctggcaaggcgcatagnnnnnn

SEQ ID NO: 282262 - DNA, 155 bp, Homo sapiens
  misc_feature: GYAE6OF01CNIBF.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaactaactgtggctgcacaatctgtcttcatcttcccgccatctgatcgtactgcgctgagcgggctggcaaggcgcatagnn

SEQ ID NO: 282263 - DNA, 178 bp, Homo sapiens
  misc_feature: GYAE6OF01DMT4K.1.24.C02.1.454.CMB.1.raw
  modified_base (157)..(178): a, c, t, g, unknown or other
  misc_feature (157)..(178): n is a, c, g, or t
tcagacgagtgcgtcacgaccggtgctcgatttagtacagatcgttaagggaaagggaccaaggtggagatcaaacgaactgtggctgcaccatctgtcttcatccttcccgccatctgatatacgatcgctgagcgggctggctaaggcgcatagnnnnnnnnnnnnnnnnnnnnnn

SEQ ID NO: 282264 - DNA, 154 bp, Homo sapiens; identical to SEQ ID NO: 281681
  misc_feature: GYAE6OF01BMWPB.1.24.C02.1.454.CMB.1.raw
  modified_base (154)..(154): a, c, t, g, unknown or other
  misc_feature (154)..(154): n is a, c, g, or t

SEQ ID NO: 282265 - DNA, 154 bp, Homo sapiens; identical to SEQ ID NO: 281681
  misc_feature: GYAE6OF01A7YY0.1.24.C02.1.454.CMB.1.raw
  modified_base (154)..(154): a, c, t, g, unknown or other
  misc_feature (154)..(154): n is a, c, g, or t

SEQ ID NO: 282266 - DNA, 172 bp, Homo sapiens
  misc_feature: GYAE6OF01EV5PB.1.24.C02.1.454.CMB.1.raw
  modified_base (154)..(172): a, c, t, g, unknown or other
  misc_feature (154)..(172): n is a, c, g, or t
tcagacgagtgcgtcacgaccggtgctcgatttagtacagatcgttagggaaagggaccaaggtggagatcaaactaactgtggctgcacaatctgtcttcatcttcccgccatctgatcgtactgcgctgagcgggctggcaaggcgcatagnnnnnnnnnnnnnnnnnnn

SEQ ID NO: 282267 - DNA, 155 bp, Homo sapiens; identical to SEQ ID NO: 281693
  misc_feature: GYAE6OF01EE7IU.1.24.C02.1.454.CMB.1.raw
  modified_base (154)..(155): a, c, t, g, unknown or other
  misc_feature (154)..(155): n is a, c, g, or t

SEQ ID NO: 282268 - DNA, 153 bp, Homo sapiens; identical to SEQ ID NO: 282002
  misc_feature: GYAE6OF01BMWL0.1.24.C02.1.454.CMB.1.raw

SEQ ID NO: 282269 - DNA, 166 bp, Homo sapiens
  misc_feature: GYAE6OF01BMUJ1.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgaagtcgctagactgagcgggctggcaaggcgcatagnnnnnnnnnnnn

SEQ ID NO: 282270 - DNA, 154 bp, Homo sapiens; identical to SEQ ID NO: 281552
  misc_feature: GYAE6OF01CFGX6.1.24.C02.1.454.CMB.1.raw
  modified_base (154)..(154): a, c, t, g, unknown or other
  misc_feature (154)..(154): n is a, c, g, or t

SEQ ID NO: 282271 - DNA, 155 bp, Homo sapiens; identical to SEQ ID NO: 281575
  misc_feature: GYAE6OF01BYP6J.1.24.C02.1.454.CMB.1.raw
  modified_base (154)..(155): a, c, t, g, unknown or other
  misc_feature (154)..(155): n is a, c, g, or t

SEQ ID NO: 282272 - DNA, 158 bp, Homo sapiens
  misc_feature: GYAE6OF01CVZ6C.1.24.C02.1.454.CMB.1.raw
  modified_base (147)..(147): a, c, t, g, unknown or other
  misc_feature (147)..(147): n is a, c, g, or t
  modified_base (153)..(158): a, c, t, g, unknown or other
  misc_feature (153)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgatatgtatactctgagcgggctggcaaggcncatagnnnnnn

SEQ ID NO: 282273 - DNA, 153 bp, Homo sapiens; identical to SEQ ID NO: 282002
  misc_feature: GYAE6OF01DKGXI.1.24.C02.1.454.CMB.1.raw

SEQ ID NO: 282274 - DNA, 158 bp, Homo sapiens
  misc_feature: GYAE6OF01A86KY.1.24.C02.1.454.CMB.1.raw
  modified_base (153)..(158): a, c, t, g, unknown or other
  misc_feature (153)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnnnnnn

SEQ ID NO: 282275 - DNA, 153 bp, Homo sapiens
  misc_feature: GYAE6OF01BZ90S.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgaatctgagcgggctggcaaggcgcatagn

SEQ ID NO: 282276 - DNA, 157 bp, Homo sapiens; identical to SEQ ID NO: 281599
  misc_feature: GYAE6OF01E105B.1.24.C02.1.454.CMB.1.raw
  modified_base (154)..(157): a, c, t, g, unknown or other
  misc_feature (154)..(157): n is a, c, g, or t

SEQ ID NO: 282277 - DNA, 184 bp, Homo sapiens
  misc_feature: GYAE6OF01BSRRO.1.24.C02.1.454.CMB.1.raw
  modified_base (156)..(184): a, c, t, g, unknown or other
  misc_feature (156)..(184): n is a, c, g, or t
tcagacgagtgcgtcacgaccggtgctcgatttagtacagatcgttagggaaaggtgaccaaggtggagatcaaactaactgtggctgcaccatctgtcttcatcttcccgccatctgatcgtactgcgctggagcgggctggcaaggcgcatagnnnnnnnnnnnnnnnnnnnnnnnnnnnnn

SEQ ID NO: 282278 - DNA, 154 bp, Homo sapiens; identical to SEQ ID NO: 281641
  misc_feature: GYAE6OF01B30M6.1.24.C02.1.454.CMB.1.raw
  modified_base (154)..(154): a, c, t, g, unknown or other
  misc_feature (154)..(154): n is a, c, g, or t

SEQ ID NO: 282279 - DNA, 156 bp, Homo sapiens; identical to SEQ ID NO: 281595
  misc_feature: GYAE6OF01BLV7T.1.24.C02.1.454.CMB.1.raw
  modified_base (154)..(156): a, c, t, g, unknown or other
  misc_feature (154)..(156): n is a, c, g, or t

SEQ ID NO: 282280 - DNA, 158 bp, Homo sapiens; identical to SEQ ID NO: 281713
  misc_feature: GYAE6OF01ANK2V.1.24.C02.1.454.CMB.1.raw
  modified_base (154)..(158): a, c, t, g, unknown or other
  misc_feature (154)..(158): n is a, c, g, or t

SEQ ID NO: 282281 - DNA, 155 bp, Homo sapiens; identical to SEQ ID NO: 281575
  misc_feature: GYAE6OF01AZSXY.1.24.C02.1.454.CMB.1.raw
  modified_base (154)..(155): a, c, t, g, unknown or other
  misc_feature (154)..(155): n is a, c, g, or t

SEQ ID NO: 282282 - DNA, 156 bp, Homo sapiens; identical to SEQ ID NO: 281888
  misc_feature: GYAE6OF01CH7Z1.1.24.C02.1.454.CMB.1.raw
  modified_base (154)..(156): a, c, t, g, unknown or other
  misc_feature (154)..(156): n is a, c, g, or t

SEQ ID NO: 282283 - DNA, 159 bp, Homo sapiens; identical to SEQ ID NO: 281835
  misc_feature: GYAE6OF01BRUJZ.1.24.C02.1.454.CMB.1.raw
  modified_base (154)..(159): a, c, t, g, unknown or other
  misc_feature (154)..(159): n is a, c, g, or t

SEQ ID NO: 282284 - DNA, 188 bp, Homo sapiens
  misc_feature: GYAE6OF01C6LN8.1.24.C02.1.454.CMB.1.raw
  modified_base (153)..(153): a, c, t, g, unknown or other
  misc_feature (153)..(153): n is a, c, g, or t
  modified_base (159)..(188): a, c, t, g, unknown or other
  misc_feature (159)..(188): n is a, c, g, or t
tcagacgagtgcgtcacgaccggtgctcgatttagtacagatcgttagggaaagggtaccggaaggtggagatcaaacgactgtggctgcaccatctgtcttcatccttcccgcatcctgacctcgcgatatctgagcgggctgggcaaggcncatagnnnnnnnnnnnnnnnnnnnnnnnnnnnnnn

SEQ ID NO: 282285 - DNA, 155 bp, Homo sapiens; identical to SEQ ID NO: 281555
  misc_feature: GYAE6OF01E0DI7.1.24.C02.1.454.CMB.1.raw
  modified_base (154)..(155): a, c, t, g, unknown or other
  misc_feature (154)..(155): n is a, c, g, or t

SEQ ID NO: 282286 - DNA, 157 bp, Homo sapiens; identical to SEQ ID NO: 281599
  misc_feature: GYAE6OF01AZYTJ.1.24.C02.1.454.CMB.1.raw
  modified_base (154)..(157): a, c, t, g, unknown or other
  misc_feature (154)..(157): n is a, c, g, or t

SEQ ID NO: 282287 - DNA, 155 bp, Homo sapiens; identical to SEQ ID NO: 281555
  misc_feature: GYAE6OF01C60IA.1.24.C02.1.454.CMB.1.raw
  modified_base (154)..(155): a, c, t, g, unknown or other
  misc_feature (154)..(155): n is a, c, g, or t

SEQ ID NO: 282288 - DNA, 177 bp, Homo sapiens
  misc_feature: GYAE6OF01DTJS5.1.24.C02.1.454.CMB.1.raw
  modified_base (154)..(177): a, c, t, g, unknown or other
  misc_feature (154)..(177): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnnnnnnnnnnnnnnnnnnnnnn

SEQ ID NO: 282289 - DNA, 154 bp, Homo sapiens; identical to SEQ ID NO: 281552
  misc_feature: GYAE6OF01BAI2D.1.24.C02.1.454.CMB.1.raw
  modified_base (154)..(154): a, c, t, g, unknown or other
  misc_feature (154)..(154): n is a, c, g, or t

SEQ ID NO: 282290 - DNA, 154 bp, Homo sapiens; identical to SEQ ID NO: 281576
  misc_feature: GYAE6OF01C8DYV.1.24.C02.1.454.CMB.1.raw
  modified_base (154)..(154): a, c, t, g, unknown or other
  misc_feature (154)..(154): n is a, c, g, or t

SEQ ID NO: 282291 - DNA, 201 bp, Homo sapiens
  misc_feature: GYAE6OF01CLFBS.1.24.C02.1.454.CMB.1.raw
  modified_base (151)..(151): a, c, t, g, unknown or other
  misc_feature (151)..(151): n is a, c, g, or t
  modified_base (157)..(158): a, c, t, g, unknown or other
  misc_feature (157)..(158): n is a, c, g, or t
  modified_base (160)..(160): a, c, t, g, unknown or other
  misc_feature (160)..(160): n is a, c, g, or t
  modified_base (162)..(163): a, c, t, g, unknown or other
  misc_feature (162)..(163): n is a, c, g, or t
  modified_base (165)..(201): a, c, t, g, unknown or other
  misc_feature (165)..(201): n is a, c, g, or t
tcagacgagtgcgtcacgaccggtgctcgatttagtacagatcgttaagggcgaagggaccaaggtggagatcaaacgaactgtggctagaaccatctgtcttcatcttcccgcatctgaatagcgtaatctgagcgggctaggcaaggcncatagnntncnngnnnnnnnnnnnnnnnnnnnnnnnnnnnnnnnnnnnnn

SEQ ID NO: 282292 - DNA, 155 bp, Homo sapiens; identical to SEQ ID NO: 281931
  misc_feature: GYAE6OF01CNXD9.1.24.C02.1.454.CMB.1.raw
  modified_base (154)..(155): a, c, t, g, unknown or other
  misc_feature (154)..(155): n is a, c, g, or t

SEQ ID NO: 282293 - DNA, 156 bp, Homo sapiens; identical to SEQ ID NO: 281661
  misc_feature: GYAE6OF01EZNG2.1.24.C02.1.454.CMB.1.raw
  modified_base (154)..(156): a, c, t, g, unknown or other
  misc_feature (154)..(156): n is a, c, g, or t

SEQ ID NO: 282294 - DNA, 222 bp, Homo sapiens
  misc_feature: GYAE6OF01BUIE7.1.24.C02.1.454.CMB.1.raw
  modified_base (166)..(222): a, c, t, g, unknown or other
  misc_feature (166)..(222): n is a, c, g, or t
tcagacgagtgcgtcacgaccggtgctcgatttagtacagatcgttaaggggacgaacgggaacccaaggtcgtagagtcaaaacgaacctgtggctgcaccatctgtcttcatcttcccgcatctgattagcgtactctgagcgggctgggcaacggcgcatagnnnnnnnnnnnnnnnnnnnnnnnnnnnnnnnnnnnnnnnnnnnnnnnnnnnnnnnnn

SEQ ID NO: 282295 - DNA, 176 bp, Homo sapiens
  misc_feature: GYAE6OF01EWPLZ.1.24.C02.1.454.CMB.1.raw
  modified_base (157)..(176): a, c, t, g, unknown or other
  misc_feature (157)..(176): n is a, c, g, or t
tcagacgagtgcgtcacgaccggtgctcgatttagtacagatcgttagggaaagggaccgaagggtggagatcaaacgaactgtggctgcaccatctgtcttcatcttcccgccatctgatacggtgagctctgagcgggctggcaaggcgcatagnnnnnnnnnnnnnnnnnnnn

SEQ ID NO: 282296 - DNA, 158 bp, Homo sapiens
  misc_feature: GYAE6OF01CH7W5.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggcaagggaccaaggtggagatcaaacgaactgtggctgcaccatctgtcttcatccttcccgccatctgaatagcgtactctgagcgggctggcaaggcgcatagnnnn

SEQ ID NO: 282297 - DNA, 156 bp, Homo sapiens; identical to SEQ ID NO: 281661
  misc_feature: GYAE6OF01ADX9T.1.24.C02.1.454.CMB.1.raw
  modified_base (154)..(156): a, c, t, g, unknown or other
  misc_feature (154)..(156): n is a, c, g, or t

SEQ ID NO: 282298 - DNA, 184 bp, Homo sapiens
  misc_feature: GYAE6OF01BAHSY.1.24.C02.1.454.CMB.1.raw
  modified_base (148)..(148): a, c, t, g, unknown or other
  misc_feature (148)..(148): n is a, c, g, or t
  modified_base (154)..(184): a, c, t, g, unknown or other
  misc_feature (154)..(184): n is a, c, g, or t
tcagacgagtgcgtcacgaccggtgctcgatttagtacagatcgttagggcaaggggaccaaggtggagatcaaacgaactgtggctgcaccatctgtcttcatcttcccgccatctgaatagctactctgagcgggctggcaaggcncatagnnnnnnnnnnnnnnnnnnnnnnnnnnnnnnn

SEQ ID NO: 282299 - DNA, 162 bp, Homo sapiens
  misc_feature: GYAE6OF01BU3AP.1.24.C02.1.454.CMB.1.raw
  modified_base (126)..(126): a, c, t, g, unknown or other
  misc_feature (126)..(126): n is a, c, g, or t
  modified_base (148)..(148): a, c, t, g, unknown or other
  misc_feature (148)..(148): n is a, c, g, or t
  modified_base (154)..(162): a, c, t, g, unknown or other
  misc_feature (154)..(162): n is a, c, g, or t
tcagacgagtgcgtcacgaccggtgctcgatttagtacagatcgttagggcaagggaccaaggtggagatcaaacgaactgtggctgcaccatctgtcttcatctcccgcatctgaatgcgtactntggagcgggctggacaagggcncatagnnnnnnnnn

SEQ ID NO: 282300 - DNA, 154 bp, Homo sapiens; identical to SEQ ID NO: 281552
  misc_feature: GYAE6OF01COV5S.1.24.C02.1.454.CMB.1.raw
  modified_base (154)..(154): a, c, t, g, unknown or other
  misc_feature (154)..(154): n is a, c, g, or t

SEQ ID NO: 282301 - DNA, 152 bp, Homo sapiens
  misc_feature: GYAE6OF01D92HL.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccgcatctgaacgcactcgtctgagcgggctggcaaggcgcatag

SEQ ID NO: 282302 - DNA, 156 bp, Homo sapiens
  misc_feature: GYAE6OF01DTY6O.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggcaagggaccaaggtggagatcaaacgaactgtggctgcaccatctgtcttcatcttcccaccctcctcacgtagcgtgctgagcgggctggcaaggcgcatagnnn

SEQ ID NO: 282303 - DNA, 154 bp, Homo sapiens; identical to SEQ ID NO: 281598
  misc_feature: GYAE6OF01D8TDA.1.24.C02.1.454.CMB.1.raw
  modified_base (154)..(154): a, c, t, g, unknown or other
  misc_feature (154)..(154): n is a, c, g, or t

SEQ ID NO: 282304 - DNA, 158 bp, Homo sapiens
  misc_feature: GYAE6OF01BCGZ4.1.24.C02.1.454.CMB.1.raw
  modified_base (153)..(158): a, c, t, g, unknown or other
  misc_feature (153)..(158): n is a, c, g, or t
tcagacgagtgcgtcacgaccggtgctcgatttagtacagatcgttagggaagggaccaaggtggagatcaaacgaactgttgctgcaccatctgtcttcatcttcccgccatctgatcgtagcactctgagcgggctggcaaggcgcatagnnnnnn

SEQ ID NO: 282305 - DNA, 156 bp, Homo sapiens; identical to SEQ ID NO: 281566
  misc_feature: GYAE6OF01AKK6H.1.24.C02.1.454.CMB.1.raw
  modified_base (154)..(156): a, c, t, g, unknown or other
  misc_feature (154)..(156): n is a, c, g, or t

SEQ ID NO: 282306 - DNA, 176 bp, Homo sapiens
  misc_feature: GYAE6OF01EDUJJ.1.24.C02.1.454.CMB.1.raw
  modified_base (152)..(152): a, c, t, g, unknown or other
  misc_feature (152)..(152): n is a, c, g, or t
  modified_base (157)..(176): a, c, t, g, unknown or other
  misc_feature (157)..(176): n is a, c, g, or t
tcagacgagtgcgtcacgaccggtgctcgatttagtacagatcgttagggcgaagggaccaagggtggagatcaaacgaactgtggctggcaccatctgtcttcatccttcccgccatctcgaatagctactgtgagcgggctggcaaggcncatgnnnnnnnnnnnnnnnnnnnn

SEQ ID NO: 282307 - DNA, 158 bp, Homo sapiens
  misc_feature: GYAE6OF01BMK5A.1.24.C02.1.454.CMB.1.raw
  modified_base (148)..(148): a, c, t, g, unknown or other
  misc_feature (148)..(148): n is a, c, g, or t
  modified_base (154)..(158): a, c, t, g, unknown or other
  misc_feature (154)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcncatagnnnnn

SEQ ID NO: 282308 - DNA, 156 bp, Homo sapiens
  misc_feature: GYAE6OF01CRX7T.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggcaagggaccaaggtgtagatcaaacgaactgtggctgcaccatctgtcttcatcttcccgcatctgaatagcgtactctgagcgggctggcaaggcgcatagnnnn

SEQ ID NO: 282309 - DNA, 155 bp, Homo sapiens; identical to SEQ ID NO: 281753
  misc_feature: GYAE6OF01CN35C.1.24.C02.1.454.CMB.1.raw
  modified_base (154)..(155): a, c, t, g, unknown or other
  misc_feature (154)..(155): n is a, c, g, or t

SEQ ID NO: 282310 - DNA, 154 bp, Homo sapiens
  misc_feature: GYAE6OF01C3HC9.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaacatctgtcttcatcttcccgccatctgaacgcactcgtctgagcgggctggcaaggcgcatagn

SEQ ID NO: 282311 - DNA, 156 bp, Homo sapiens; identical to SEQ ID NO: 281888
  misc_feature: GYAE6OF01EW6VX.1.24.C02.1.454.CMB.1.raw
  modified_base (154)..(156): a, c, t, g, unknown or other
  misc_feature (154)..(156): n is a, c, g, or t

SEQ ID NO: 282312 - DNA, 152 bp, Homo sapiens
  misc_feature: GYAE6OF01BWUFO.1.24.C02.1.454.CMB.1.raw
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatag

SEQ ID NO: 282313 - DNA, 178 bp, Homo sapiens
  misc_feature: GYAE6OF01DX84V.1.24.C02.1.454.CMB.1.raw
  modified_base (157)..(178): a, c, t, g, unknown or other
  misc_feature (157)..(178): n is a, c, g, or t
tcagacgagtgcgtcacgaccggtgctcgatttagtacagatcgttagggcaagggaccaagggtggagatcaaacgaactgtggctgcaccatctgtcttcaatccttcccgccatctgaatagcgtactctgagcgggctggcaaggcgcatagnnnnnnnnnnnnnnnnnnnnnn

SEQ ID NO: 282314 - DNA, 157 bp, Homo sapiens
  misc_feature: GYAE6OF01D542F.1.24.C02.1.454.CMB.1.raw
  modified_base (152)..(157): a, c, t, g, unknown or other
  misc_feature (152)..(157): n is a, c, g, or t
tcagacgagtgcgtcacgaccggtgctcgatttagtacagatcgttagtgcaagggaccaaggtggagatcaaacgaactgtggctgcacatctgtcttcatcttccgccatctgactcgtctctactgagcgggctggcaaggcgcatagnnnnnn

SEQ ID NO: 282315 - DNA, 158 bp, Homo sapiens; identical to SEQ ID NO: 281713
  misc_feature: GYAE6OF01EFFPU.1.24.C02.1.454.CMB.1.raw
  modified_base (154)..(158): a, c, t, g, unknown or other
  misc_feature (154)..(158): n is a, c, g, or t

SEQ ID NO: 282316 - DNA, 154 bp, Homo sapiens; identical to SEQ ID NO: 281641
  misc_feature: GYAE6OF01EU4TZ.1.24.C02.1.454.CMB.1.raw
  modified_base (154)..(154): a, c, t, g, unknown or other
  misc_feature (154)..(154): n is a, c, g, or t

SEQ ID NO: 282317 - DNA, 155 bp, Homo sapiens; identical to SEQ ID NO: 281555
  misc_feature: GYAE6OF01B6X5Q.1.24.C02.1.454.CMB.1.raw
  modified_base (154)..(155): a, c, t, g, unknown or other
  misc_feature (154)..(155): n is a, c, g, or t

SEQ ID NO: 282318 - DNA, 154 bp, Homo sapiens; identical to SEQ ID NO: 281604
  misc_feature: GYAE6OF01DALM3.1.24.C02.1.454.CMB.1.raw
  modified_base (154)..(154): a, c, t, g, unknown or other
  misc_feature (154)..(154): n is a, c, g, or t

SEQ ID NO: 282319 - DNA, 153 bp, Homo sapiens; identical to SEQ ID NO: 282002
  misc_feature: GYAE6OF01BHAS1.1.24.C02.1.454.CMB.1.raw

SEQ ID NO: 282320 - DNA, 182 bp, Homo sapiens
  misc_feature: GYAE6OF01B3F7U.1.24.C02.1.454.CMB.1.raw
  modified_base (157)..(182): a, c, t, g, unknown or other
  misc_feature (157)..(182): n is a, c, g, or t
tcagacgagtgcgtcacgaccggtgctcgatttagtacagatcgttagggcgaagggaccaaggtggagatcaaacgaactgtggctagaaccatctgtcttcatccttcccgccatctgaatagcgtactctgagcgggctggcaaggcgcatagnnnnnnnnnnnnnnnnnnnnnnnnnn

SEQ ID NO: 282321 - DNA, 156 bp, Homo sapiens; identical to SEQ ID NO: 281762
  misc_feature: GYAE6OF01AZAWV.1.24.C02.1.454.CMB.1.raw
  modified_base (154)..(156): a, c, t, g, unknown or other
  misc_feature (154)..(156): n is a, c, g, or t

SEQ ID NO: 282322 - DNA, 156 bp, Homo sapiens; identical to SEQ ID NO: 281888
  misc_feature: GYAE6OF01D9V3E.1.24.C02.1.454.CMB.1.raw
  modified_base (154)..(156): a, c, t, g, unknown or other
  misc_feature (154)..(156): n is a, c, g, or t

SEQ ID NO: 282323 - DNA, 154 bp, Homo sapiens; identical to SEQ ID NO: 281584
  misc_feature: GYAE6OF01DSHQE.1.24.C02.1.454.CMB.1.raw
  modified_base (154)..(154): a, c, t, g, unknown or other
  misc_feature (154)..(154): n is a, c, g, or t

SEQ ID NO: 282324 - DNA, 153 bp, Homo sapiens
  misc_feature: GYAE6OF01ERGGJ.1.24.C02.1.454.CMB.1.raw
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatag

SEQ ID NO: 282325 - DNA, 161 bp, Homo sapiens
  misc_feature: GYAE6OF01ANOJJ.1.24.C02.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacagatcgttagggcaagggacccaaggtggagatcaaacgaactgtggctgcaccatctgtcttcatcttcccgccatctgaatagcgtactctgagcgggctggcaaggcgcatagnnnnnnn

SEQ ID NO: 282326 - DNA, 154 bp, Homo sapiens; identical to SEQ ID NO: 281681
  misc_feature: GYAE6OF01C0IPO.1.24.C02.1.454.CMB.1.raw
  modified_base (154)..(154): a, c, t, g, unknown or other
  misc_feature (154)..(154): n is a, c, g, or t

SEQ ID NO: 282327 - DNA, 157 bp, Homo sapiens; identical to SEQ ID NO: 281599
  misc_feature: GYAE6OF01DN0NN.1.24.C02.1.454.CMB.1.raw
  modified_base (154)..(157): a, c, t, g, unknown or other
  misc_feature (154)..(157): n is a, c, g, or t

SEQ ID NO: 282328 - DNA, 156 bp, Homo sapiens; identical to SEQ ID NO: 281595
  misc_feature: GYAE6OF01BMFRC.1.24.C02.1.454.CMB.1.raw
  modified_base (154)..(156): a, c, t, g, unknown or other
  misc_feature (154)..(156): n is a, c, g, or t

SEQ ID NO: 282329 - DNA, 157 bp, Homo sapiens
  misc_feature: GYAE6OF01DVVVC.1.24.C02.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtacagatcgttagggcaagggaccaaggtggagatcaaacgaactgtggctgcaccatctgtcttcatcttcccggccatctgaatagcgtactctgagcgggctggcaaggcgcatagnnn

SEQ ID NO: 282330 - DNA, 154 bp, Homo sapiens; identical to SEQ ID NO: 281552
  misc_feature: GYAE6OF01C6HBB.1.24.C02.1.454.CMB.1.raw
  modified_base (154)..(154): a, c, t, g, unknown or other
  misc_feature (154)..(154): n is a, c, g, or t

SEQ ID NO: 282331 - DNA, 155 bp, Homo sapiens
  misc_feature: GYAE6OF01AIUUB.1.24.C02.1.454.CMB.1.raw
  modified_base (129)..(129): a, c, t, g, unknown or other
  misc_feature (129)..(129): n is a, c, g, or t
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactntgagcgggctggcaaggcgcatagnn

SEQ ID NO: 282332 - DNA, 155 bp, Homo sapiens
  misc_feature: GYAE6OF01A09J8.1.24.C02.1.454.CMB.1.raw
  modified_base (148)..(148): a, c, t, g, unknown or other
  misc_feature (148)..(148): n is a, c, g, or t
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatccttcccgcatctgactcgcgatatctgagcgggctggcaaggcncatagnn

SEQ ID NO: 282333 - DNA, 154 bp, Homo sapiens; identical to SEQ ID NO: 281576
  misc_feature: GYAE6OF01EUVOS.1.24.C02.1.454.CMB.1.raw
  modified_base (154)..(154): a, c, t, g, unknown or other
  misc_feature (154)..(154): n is a, c, g, or t

SEQ ID NO: 282334 - DNA, 159 bp, Homo sapiens
  misc_feature: GYAE6OF01ER5RJ.1.24.C02.1.454.CMB.1.raw
  modified_base (148)..(148): a, c, t, g, unknown or other
  misc_feature (148)..(148): n is a, c, g, or t
  modified_base (154)..(159): a, c, t, g, unknown or other
  misc_feature (154)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcncatagnnnnnn

SEQ ID NO: 282335 - DNA, 157 bp, Homo sapiens; identical to SEQ ID NO: 281599
  misc_feature: GYAE6OF01A6RX4.1.24.C02.1.454.CMB.1.raw
  modified_base (154)..(157): a, c, t, g, unknown or other
  misc_feature (154)..(157): n is a, c, g, or t

SEQ ID NO: 282336 - DNA, 155 bp, Homo sapiens; identical to SEQ ID NO: 281675
  misc_feature: GYAE6OF01CX0XN.1.24.C02.1.454.CMB.1.raw
  modified_base (154)..(155): a, c, t, g, unknown or other
  misc_feature (154)..(155): n is a, c, g, or t

SEQ ID NO: 282337 - DNA, 156 bp, Homo sapiens
  misc_feature: GYAE6OF01B9BAF.1.24.C02.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcgggctggcaaggcgcaatagnn

SEQ ID NO: 282338 - DNA, 153 bp, Homo sapiens
  misc_feature: GYAE6OF01C1Q8Z.1.24.C02.1.454.CMB.1.raw
  modified_base (127)..(127): a, c, t, g, unknown or other
  misc_feature (127)..(127): n is a, c, g, or t
  modified_base (145)..(145): a, c, t, g, unknown or other
  misc_feature (145)..(145): n is a, c, g, or t
  modified_base (149)..(153): a, c, t, g, unknown or other
  misc_feature (149)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagctactntgagcggctggcaaggcnatgnnnnn

SEQ ID NO: 282339 - DNA, 253 bp, Homo sapiens
  misc_feature: GYAE6OF01BWGO6.1.24.C02.1.454.CMB.1.raw
  modified_base (167)..(169): a, c, t, g, unknown or other
  misc_feature (167)..(169): n is a, c, g, or t
  modified_base (171)..(175): a, c, t, g, unknown or other
  misc_feature (171)..(175): n is a, c, g, or t
  modified_base (177)..(177): a, c, t, g, unknown or other
  misc_feature (177)..(177): n is a, c, g, or t
  modified_base (179)..(253): a, c, t, g, unknown or other
  misc_feature (179)..(253): n is a, c, g, or t
tcagacgagtgcgtcacgaccggtgctcgatttagtacagatcgttagggcgtaaggggaccaaggtggacgatcaaaacggaactgtggctgcaccatctggtccttcatcttcccgcccagtctcgaatagcgtactctggagccgggctggcaaggcgcatagnnncnnnnncncnnnnnnnnnnnnnnnnnnnnnnnnnnnnnnnnnnnnnnnnnnnnnnnnnnnnnnnnnnnnnnnnnnnnnnnnnnn

SEQ ID NO: 282340 - DNA, 154 bp, Homo sapiens; identical to SEQ ID NO: 281552
  misc_feature: GYAE6OF01BQ4QO.1.24.C02.1.454.CMB.1.raw
  modified_base (154)..(154): a, c, t, g, unknown or other
  misc_feature (154)..(154): n is a, c, g, or t

SEQ ID NO: 282341 - DNA, 161 bp, Homo sapiens
  misc_feature: GYAE6OF01BL41V.1.24.C02.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacagatcgttagggaaagggaccaagggtggagatcaaacgaactgttgctgcaccatctgtcttcatcttcccgccatctgatcgtagcactctgagcgggctggcaaggcgcatagnnnnnnn

SEQ ID NO: 282342 - DNA, 156 bp, Homo sapiens; identical to SEQ ID NO: 281661
  misc_feature: GYAE6OF01A7QTB.1.24.C02.1.454.CMB.1.raw
  modified_base (154)..(156): a, c, t, g, unknown or other
  misc_feature (154)..(156): n is a, c, g, or t

SEQ ID NO: 282343 - DNA, 159 bp, Homo sapiens; identical to SEQ ID NO: 282060
  misc_feature: GYAE6OF01A8Z21.1.24.C02.1.454.CMB.1.raw
  modified_base (154)..(159): a, c, t, g, unknown or other
  misc_feature (154)..(159): n is a, c, g, or t

SEQ ID NO: 282344 - DNA, 154 bp, Homo sapiens; identical to SEQ ID NO: 281607
  misc_feature: GYAE6OF01EG9ZV.1.24.C02.1.454.CMB.1.raw
  modified_base (154)..(154): a, c, t, g, unknown or other
  misc_feature (154)..(154): n is a, c, g, or t

SEQ ID NO: 282345 - DNA, 154 bp, Homo sapiens; identical to SEQ ID NO: 281572
  misc_feature: GYAE6OF01CRWDW.1.24.C02.1.454.CMB.1.raw
  modified_base (154)..(154): a, c, t, g, unknown or other
  misc_feature (154)..(154): n is a, c, g, or t

SEQ ID NO: 282346 - DNA, 155 bp, Homo sapiens; identical to SEQ ID NO: 281697
  misc_feature: GYAE6OF01AIRCY.1.24.C02.1.454.CMB.1.raw
  modified_base (154)..(155): a, c, t, g, unknown or other
  misc_feature (154)..(155): n is a, c, g, or t

SEQ ID NO: 282347 - DNA, 156 bp, Homo sapiens; identical to SEQ ID NO: 281888
  misc_feature: GYAE6OF01CC0KR.1.24.C02.1.454.CMB.1.raw
  modified_base (154)..(156): a, c, t, g, unknown or other
  misc_feature (154)..(156): n is a, c, g, or t

SEQ ID NO: 282348 - DNA, 171 bp, Homo sapiens
  misc_feature: GYAE6OF01AGK2J.1.24.C02.1.454.CMB.1.raw
  modified_base (156)..(171): a, c, t, g, unknown or other
  misc_feature (156)..(171): n is a, c, g, or t
tcagacgagtgcgtcacgaccggtgctcgatttagtacagatcgttagggcgaagggaccaaggtggagatccaaacgaactgtggctgcaccatctgtcttcatcttcccgccatctgaatagcgtactctgagcgggctggcaaggcgcatagnnnnnnnnnnnnnnnn

SEQ ID NO: 282349 - DNA, 156 bp, Homo sapiens; identical to SEQ ID NO: 281762
  misc_feature: GYAE6OF01EB1ZE.1.24.C02.1.454.CMB.1.raw
  modified_base (154)..(156): a, c, t, g, unknown or other
  misc_feature (154)..(156): n is a, c, g, or t

SEQ ID NO: 282350 - DNA, 158 bp, Homo sapiens
  misc_feature: GYAE6OF01C5IHB.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgaggcgggctggcaaggcgcatagnnnn

SEQ ID NO: 282351 - DNA, 155 bp, Homo sapiens
  misc_feature: GYAE6OF01EYZ5Y.1.24.C02.1.454.CMB.1.raw
  modified_base (147)..(147): a, c, t, g, unknown or other
  misc_feature (147)..(147): n is a, c, g, or t
  modified_base (153)..(155): a, c, t, g, unknown or other
  misc_feature (153)..(155): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcggctggcaaggcncatagnnn

SEQ ID NO: 282352 - DNA, 157 bp, Homo sapiens
  misc_feature: GYAE6OF01BCXTC.1.24.C02.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtacagatcgttagggcaagggaccaaggtggagatcaaacgaactgtggctgaaccatctgtcttcatccttcccgccatctgaatagcgtacctgaggcgggctggcaaggcgcatagnnn

SEQ ID NO: 282353 - DNA, 172 bp, Homo sapiens
  misc_feature: GYAE6OF01BTYSA.1.24.C02.1.454.CMB.1.raw
  modified_base (158)..(172): a, c, t, g, unknown or other
  misc_feature (158)..(172): n is a, c, g, or t
tcagacgagtgcgtcacgaccggtgctcgatttagtacagatcgttagggcaagggaccaaggtggagatcaaacgaactgtggctgcaccatctgtcttcatccttcccgctatctgaatgcgtactctggaggccgggctgggacaaggcatatgnnnnnnnnnnnnnnn

SEQ ID NO: 282354 - DNA, 154 bp, Homo sapiens
  misc_feature: GYAE6OF01B5P77.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatcgtagcactctgagcgggctggcaaggcgcaatagn

SEQ ID NO: 282355 - DNA, 159 bp, Homo sapiens
  misc_feature: GYAE6OF01AIOE8.1.24.C02.1.454.CMB.1.raw
  modified_base (148)..(148): a, c, t, g, unknown or other
  misc_feature (148)..(148): n is a, c, g, or t
  modified_base (154)..(159): a, c, t, g, unknown or other
  misc_feature (154)..(159): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcncatagnnnnnn

SEQ ID NO: 282356 - DNA, 155 bp, Homo sapiens; identical to SEQ ID NO: 281753
  misc_feature: GYAE6OF01EDKM3.1.24.C02.1.454.CMB.1.raw
  modified_base (154)..(155): a, c, t, g, unknown or other
  misc_feature (154)..(155): n is a, c, g, or t

SEQ ID NO: 282357 - DNA, 153 bp, Homo sapiens
  misc_feature: GYAE6OF01CUGNB.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatag

SEQ ID NO: 282358 - DNA, 154 bp, Homo sapiens; identical to SEQ ID NO: 281614
  misc_feature: GYAE6OF01BM5QJ.1.24.C02.1.454.CMB.1.raw
  modified_base (154)..(154): a, c, t, g, unknown or other
  misc_feature (154)..(154): n is a, c, g, or t

SEQ ID NO: 282359 - DNA, 154 bp, Homo sapiens; identical to SEQ ID NO: 281576
  misc_feature: GYAE6OF01EUDD4.1.24.C02.1.454.CMB.1.raw
  modified_base (154)..(154): a, c, t, g, unknown or other
  misc_feature (154)..(154): n is a, c, g, or t

SEQ ID NO: 282360 - DNA, 156 bp, Homo sapiens
  misc_feature: GYAE6OF01ELCOO.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgatcctcgactctgagcgggctggcaaggcgcatagnnn

SEQ ID NO: 282361 - DNA, 158 bp, Homo sapiens
  misc_feature: GYAE6OF01DFVRU.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnn

SEQ ID NO: 282362 - DNA, 162 bp, Homo sapiens
  misc_feature: GYAE6OF01DI7DK.1.24.C02.1.454.CMB.1.raw
  modified_base (155)..(162): a, c, t, g, unknown or other
  misc_feature (155)..(162): n is a, c, g, or t
tcagacgagtgcgtcacgaccggtgctcgatttagtacagatcgttagggaaagggaccaaggtggagatcaaactaactgtggctgcaccatctgtcttcatcttcccgccatctgatcgtactgcgctgaggcgggctggcaaggcgcatagnnnnnnnn

SEQ ID NO: 282363 - DNA, 155 bp, Homo sapiens
  misc_feature: GYAE6OF01B5CMA.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggcaagggaccaaggtggagatcaaacgaactgtggctgcaccatctgtcttcatcttcccgccatcgaatagcgtactctgagcgggctggcaaggcgcatagnnn

SEQ ID NO: 282364 - DNA, 156 bp, Homo sapiens; identical to SEQ ID NO: 282308
  misc_feature: GYAE6OF01BNC7T.1.24.C02.1.454.CMB.1.raw
  modified_base (153)..(156): a, c, t, g, unknown or other
  misc_feature (153)..(156): n is a, c, g, or t

SEQ ID NO: 282365 - DNA, 158 bp, Homo sapiens
  misc_feature: GYAE6OF01BJ5P7.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgaatagcgtactctgagcggggctgggcaaggcgcatagnnnn

SEQ ID NO: 282366 - DNA, 164 bp, Homo sapiens; identical to SEQ ID NO: 281630
  misc_feature: GYAE6OF01CQW3G.1.24.C02.1.454.CMB.1.raw
  modified_base (154)..(164): a, c, t, g, unknown or other
  misc_feature (154)..(164): n is a, c, g, or t

SEQ ID NO: 282367 - DNA, 187 bp, Homo sapiens
  misc_feature: GYAE6OF01A8F1L.1.24.C02.1.454.CMB.1.raw
  modified_base (150)..(150): a, c, t, g, unknown or other
  misc_feature (150)..(150): n is a, c, g, or t
  modified_base (155)..(187): a, c, t, g, unknown or other
  misc_feature (155)..(187): n is a, c, g, or t
tcagacgagtgcgtcacgaccggtgctcgatttagtacagatcgttagggcgaaggggaccaaggtggagatcaaacggaactgtggctgcaccatctgtcttcatcttcccgccatctgatgcgtactctgagcggctggacaaggcgnatagnnnnnnnnnnnnnnnnnnnnnnnnnnnnnnnnn

SEQ ID NO: 282368 - DNA, 164 bp, Homo sapiens
  misc_feature: GYAE6OF01BD3A1.1.24.C02.1.454.CMB.1.raw
  modified_base (153)..(153): a, c, t, g, unknown or other
  misc_feature (153)..(153): n is a, c, g, or t
  modified_base (158)..(164): a, c, t, g, unknown or other
  misc_feature (158)..(164): n is a, c, g, or t
tcagacgagtgcgtcacgaccggtgctcgatttagtacagatcgttagggcaagggaccaaggtggagatcaaacgaactgtggctgaaccatctgtcttcatccttcccgcatctagaatagccgtactctggagcgggctggcaaggcganatagnnnnnnn

SEQ ID NO: 282369 - DNA, 160 bp, Homo sapiens
  misc_feature: GYAE6OF01AYACV.1.24.C02.1.454.CMB.1.raw
  modified_base (156)..(160): a, c, t, g, unknown or other
  misc_feature (156)..(160): n is a, c, g, or t
tcagacgagtgcgtcacgaccggtgctcgatttagtacagatcgttagggaaagggaccaaggtggagatcaaacgaactgttgctgcaccatctgtcttcatcttcccgcatctgatcgtagcactctgaggcgggctgggacaaggcgcatagnnnnn

SEQ ID NO: 282370 - DNA, 188 bp, Homo sapiens
  misc_feature: GYAE6OF01BHJST.1.24.C02.1.454.CMB.1.raw
  modified_base (139)..(139): a, c, t, g, unknown or other
  misc_feature (139)..(139): n is a, c, g, or t
  modified_base (149)..(149): a, c, t, g, unknown or other
  misc_feature (149)..(149): n is a, c, g, or t
  modified_base (155)..(188): a, c, t, g, unknown or other
  misc_feature (155)..(188): n is a, c, g, or t
tcagacgagtgcgtcacgaccggtgctcgatttagtacagatcgttagggaaaggggaccaaggtggagatcaaacgaactgtggctgcaccatctgtcttcatccttcccgcatctgatatacgatcgctgagcgggntggcaaggcncatagnnnnnnnnnnnnnnnnnnnnnnnnnnnnnnnnnn

SEQ ID NO: 282371 - DNA, 156 bp, Homo sapiens; identical to SEQ ID NO: 281888
  misc_feature: GYAE6OF01AE828.1.24.C02.1.454.CMB.1.raw
  modified_base (154)..(156): a, c, t, g, unknown or other
  misc_feature (154)..(156): n is a, c, g, or t

SEQ ID NO: 282372 - DNA, 159 bp, Homo sapiens; identical to SEQ ID NO: 281682
  misc_feature: GYAE6OF01AOBMS.1.24.C02.1.454.CMB.1.raw
  modified_base (154)..(159): a, c, t, g, unknown or other
  misc_feature (154)..(159): n is a, c, g, or t

SEQ ID NO: 282373 - DNA, 165 bp, Homo sapiens; identical to SEQ ID NO: 282200
  misc_feature: GYAE6OF01ETDQ0.1.24.C02.1.454.CMB.1.raw
  modified_base (154)..(165): a, c, t, g, unknown or other
  misc_feature (154)..(165): n is a, c, g, or t

SEQ ID NO: 282374 - DNA, 161 bp, Homo sapiens
  misc_feature: GYAE6OF01ERKGD.1.24.C02.1.454.CMB.1.raw
  modified_base (158)..(161): a, c, t, g, unknown or other
  misc_feature (158)..(161): n is a, c, g, or t
tcagacgagtgcgtcacgaccggtgctcgatttagtacagatcgttagggaaagggaccaaggtggagatcaaactaactgtggctgcaccatctgtcttcatccttcccgcatctgatcgtactgcgctggaggccgggctaggcaaggcgcaatgnnnn

SEQ ID NO: 282375 - DNA, 184 bp, Homo sapiens
  misc_feature: GYAE6OF01CFTKV.1.24.C02.1.454.CMB.1.raw
  modified_base (131)..(131): a, c, t, g, unknown or other
  misc_feature (131)..(131): n is a, c, g, or t
  modified_base (155)..(156): a, c, t, g, unknown or other
  misc_feature (155)..(156): n is a, c, g, or t
  modified_base (159)..(184): a, c, t, g, unknown or other
  misc_feature (159)..(184): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgatatgtatacctntgagcggctggcaaggctcaatgnngannnnnnnnnnnnnnnnnnnnnnnnnn

SEQ ID NO: 282376 - DNA, 742 bp, Homo sapiens
  misc_feature: GYAE6OF01DSR09.1.24.C02.1.454.CMB.1.raw
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (483)..(483): a, c, t, g, unknown or other
  misc_feature (483)..(483): n is a, c, g, or t
  modified_base (548)..(548): a, c, t, g, unknown or other
  misc_feature (548)..(548): n is a, c, g, or t
  modified_base (607)..(607): a, c, t, g, unknown or other
  misc_feature (607)..(607): n is a, c, g, or t
  modified_base (657)..(657): a, c, t, g, unknown or other
  misc_feature (657)..(657): n is a, c, g, or t
  modified_base (669)..(669): a, c, t, g, unknown or other
  misc_feature (669)..(669): n is a, c, g, or t
  modified_base (677)..(677): a, c, t, g, unknown or other
  misc_feature (677)..(677): n is a, c, g, or t
  modified_base (721)..(721): a, c, t, g, unknown or other
  misc_feature (721)..(721): n is a, c, g, or t
  modified_base (730)..(730): a, c, t, g, unknown or other
  misc_feature (730)..(730): n is a, c, g, or t
tcagacgagtgcgtcacgaccggtgctcgatttagtacagatcgttcgcggaatccgggtcctgaccgattcagtggcagcgggtctggacagatttcactctcacatcagcagcctgcagtctagaagatgtgtctagtttatactgtccagtcaattacgttataacgttcgttccgtctccgtaacgttttcgggacggaacggtaccgtaagggtcggaacgtaactaccgtaaaacgtacgttcggtacggtaccgtagtaccgtacccgtagttcccgtacggtttacctttccgtaaaccgtttcccgtttaccccggacttaaacgtttccgttaacggaacccgttccgtaaccggttccggttacgacgggtacggtacccgggtcgttaacgggaccggtaaacggcgtaccgtaagtcggctacgtagcgttaagntacgtnatccgagtacggtactcaacgtggacctntaccggtcttagaccgtatacgtcgtaaccttgacgttaaccgtggttacgaccgtttacggacncggttaactcgtgtaacgtaccgtgacggtctacgtacccgtaaggtaccctggtaacnggttaaccctagttcgtaaacccgtgtacggtcttaacggctaacggttnacccgttaaggnttaccgtnaccgtgtacgaacggtcgaacgtccctaaagggttcacgggttnaaacgggtntaaacgttcccg

SEQ ID NO: 282377 - DNA, 186 bp, Homo sapiens
  misc_feature: GYAE6OF01CYZK2.1.24.C02.1.454.CMB.1.raw
  modified_base (150)..(150): a, c, t, g, unknown or other
  misc_feature (150)..(150): n is a, c, g, or t
  modified_base (155)..(155): a, c, t, g, unknown or other
  misc_feature (155)..(155): n is a, c, g, or t
  modified_base (158)..(186): a, c, t, g, unknown or other
  misc_feature (158)..(186): n is a, c, g, or t
tcagacgagtgcgtcacgaccggtgctcgatttagtacagatcgttagggcaaagggaccaaggtggagatcaaaacgaactgtggctgcaccatctgtcttcatccttccgccatctgaatagcgtactgtgagcgggctggcaaggcnctaangcnnnnnnnnnnnnnnnnnnnnnnnnnnnnn

SEQ ID NO: 282378 - DNA, 158 bp, Homo sapiens
  misc_feature: GYAE6OF01ADQ5Z.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgatatgtatactctgagcgggctggcaaggcgcatagnnnn

SEQ ID NO: 282379 - DNA, 170 bp, Homo sapiens
  misc_feature: GYAE6OF01DABTE.1.24.C02.1.454.CMB.1.raw
  modified_base (156)..(170): a, c, t, g, unknown or other
  misc_feature (156)..(170): n is a, c, g, or t
tcagacgagtgcgtcacgaccggtgctcgatttagtacagatcgttagggaaagggaccaaggtggagatcaaacgaactgtggctgcaccatctgtcttcatctcccgcatctagaatagcgtactcgtgagcgggctggacaagggcacatagnnnnnnnnnnnnnnn

SEQ ID NO: 282380 - DNA, 162 bp, Homo sapiens
  misc_feature: GYAE6OF01A5N8M.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaagtcgctagactgagcgggctggcaaggcgcatagnnnnnnnnn

SEQ ID NO: 282381 - DNA, 178 bp, Homo sapiens
  misc_feature: GYAE6OF01BIOR5.1.24.C02.1.454.CMB.1.raw
  modified_base (155)..(178): a, c, t, g, unknown or other
  misc_feature (155)..(178): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctagaatagcgtactctgagcgggctggcaaggcgcatagnnnnnnnnnnnnnnnnnnnnnnnn

SEQ ID NO: 282382 - DNA, 164 bp, Homo sapiens
  misc_feature: GYAE6OF01BDHPR.1.24.C02.1.454.CMB.1.raw
  modified_base (153)..(164): a, c, t, g, unknown or other
  misc_feature (153)..(164): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatatacgatcgctgagcgggctggcaaggcgcatagnnnnnnnnnnnn

SEQ ID NO: 282383 - DNA, 165 bp, Homo sapiens
  misc_feature: GYAE6OF01A4XZB.1.24.C02.1.454.CMB.1.raw
  modified_base (151)..(165): a, c, t, g, unknown or other
  misc_feature (151)..(165): n is a, c, g, or t
tcagacgagtgcgtcacgaccggtgctcgatttagtacagatcgttagggaaagggaccaaggtggagatcaaacgaactgtggctgcaccatctgtctcatctcccgcatctgatcgtagcactctgagcgggctggcaaggcgcatagnnnnnnnnnnnnnnn

SEQ ID NO: 282384 - DNA, 156 bp, Homo sapiens
  misc_feature: GYAE6OF01AVHSM.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctctcgtactgcgctgagcgggctggcaaggcgcatagnnn

SEQ ID NO: 282385 - DNA, 153 bp, Homo sapiens
  misc_feature: GYAE6OF01BL1TS.1.24.C02.1.454.CMB.1.raw
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatag

SEQ ID NO: 282386 - DNA, 156 bp, Homo sapiens
  misc_feature: GYAE6OF01AUFOK.1.24.C02.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtacagatcgttagggcaagggaccaaggtggagatcaaacgaactgtggctagaaccatctgtcttcatcttcccgccatctgaatagcgtactctgagcgggctggcaaggcgcatagnn

SEQ ID NO: 282387 - DNA, 166 bp, Homo sapiens
  misc_feature: GYAE6OF01DOOUV.1.24.C02.1.454.CMB.1.raw
  modified_base (152)..(152): a, c, t, g, unknown or other
  misc_feature (152)..(152): n is a, c, g, or t
  modified_base (155)..(166): a, c, t, g, unknown or other
  misc_feature (155)..(166): n is a, c, g, or t
tcagacgagtgcgtcacgaccggtgctcgatttagtacagatcgttagggaaagggaccaaggtggagatcaaacgactgtggctgcaccatctgtcttcatcttcccgcatctgatcgtagcactcgtgagtcgggctggcaaggcgacanagnnnnnnnnnnnn

SEQ ID NO: 282388 - DNA, 158 bp, Homo sapiens; identical to SEQ ID NO: 281713
  misc_feature: GYAE6OF01BHMG5.1.24.C02.1.454.CMB.1.raw
  modified_base (154)..(158): a, c, t, g, unknown or other
  misc_feature (154)..(158): n is a, c, g, or t

SEQ ID NO: 282389 - DNA, 160 bp, Homo sapiens
  misc_feature: GYAE6OF01A2EQB.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnnnn

SEQ ID NO: 282390 - DNA, 168 bp, Homo sapiens
  misc_feature: GYAE6OF01BPZI2.1.24.C02.1.454.CMB.1.raw
  modified_base (156)..(168): a, c, t, g, unknown or other
  misc_feature (156)..(168): n is a, c, g, or t
tcagacgagtgcgtcacgaccggtgctcgatttagtacagatcgttagggcaagggaccaaggtggagatcaaacgaactgtggctgcaccatctgtcttcatccttcccaccctcctcacgtagcgtgctgagcgggcttggcaaggcgcatagnnnnnnnnnnnnn

SEQ ID NO: 282391 - DNA, 169 bp, Homo sapiens
  misc_feature: GYAE6OF01BL5VN.1.24.C02.1.454.CMB.1.raw
  modified_base (158)..(169): a, c, t, g, unknown or other
  misc_feature (158)..(169): n is a, c, g, or t
tcagacgagtgcgtcacgaccggtgctcgatttagtacagatcgttagggaaagggaccaaggtggagatcaaacgaactgtggctgcaccatctgtcttcatccttcccgcatctgaacgcactcgtctggacgcgggctggacaaggcgacatagnnnnnnnnnnnn

SEQ ID NO: 282392 - DNA, 245 bp, Homo sapiens
  misc_feature: GYAE6OF01E2GEA.1.24.C02.1.454.CMB.1.raw
  modified_base (104)..(104): a, c, t, g, unknown or other
  misc_feature (104)..(104): n is a, c, g, or t
  modified_base (163)..(165): a, c, t, g, unknown or other
  misc_feature (163)..(165): n is a, c, g, or t
  modified_base (167)..(167): a, c, t, g, unknown or other
  misc_feature (167)..(167): n is a, c, g, or t
  modified_base (173)..(174): a, c, t, g, unknown or other
  misc_feature (173)..(174): n is a, c, g, or t
  modified_base (179)..(245): a, c, t, g, unknown or other
  misc_feature (179)..(245): n is a, c, g, or t
tcagacgagtgcgtcacgaccggtgctcgatttagtacagatcgttaggggcaagggaccaaggtggacgatcaaaacgaactgtggctgcaccatctgtcttnatcttcccgcatctgaatagcgtactctggaggcggggctgggacaagggcacaatagnnngntgcagnnagcgnnnnnnnnnnnnnnnnnnnnnnnnnnnnnnnnnnnnnnnnnnnnnnnnnnnnnnnnnnnnnnnnnnn

SEQ ID NO: 282393 - DNA, 160 bp, Homo sapiens
  misc_feature: GYAE6OF01AX7GD.1.24.C02.1.454.CMB.1.raw
  modified_base (153)..(160): a, c, t, g, unknown or other
  misc_feature (153)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatgnnnnnnnn

SEQ ID NO: 282394 - DNA, 263 bp, Homo sapiens
  misc_feature: GYAE6OF01A2LM9.1.24.C02.1.454.CMB.1.raw
  modified_base (173)..(173): a, c, t, g, unknown or other
  misc_feature (173)..(173): n is a, c, g, or t
  modified_base (256)..(263): a, c, t, g, unknown or other
  misc_feature (256)..(263): n is a, c, g, or t
tcagacgagtgcgtcacgaccggtgctcgatttagtacagatcgttcgcgggaagatgaagacagatttcactctcaccatcagcagcctgcagcctgaagatttttgcaacttattactgtcaacagcttaatagttacccttacacttttggccaggggaccaagctgganatcaaacgaactgtggctgcaccatctgtcttcatcctccgcatctgaacgcactcgtctgagcggctggcaaggcgcatagnnnnnnnn

SEQ ID NO: 282395 - DNA, 171 bp, Homo sapiens
  misc_feature: GYAE6OF01DJEAA.1.24.C02.1.454.CMB.1.raw
  modified_base (146)..(146): a, c, t, g, unknown or other
  misc_feature (146)..(146): n is a, c, g, or t
  modified_base (152)..(171): a, c, t, g, unknown or other
  misc_feature (152)..(171): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcatatctgagcggctggcaaggcncatagnnnnnnnnnnnnnnnnnnnn

SEQ ID NO: 282396 - DNA, 185 bp, Homo sapiens
  misc_feature: GYAE6OF01D902J.1.24.C02.1.454.CMB.1.raw
  modified_base (160)..(185): a, c, t, g, unknown or other
  misc_feature (160)..(185): n is a, c, g, or t
tcagacgagtgcgtcacgaccggtgctcgatttagtacagatcgttagggaaagggaccaaggtggagatcaaacgaactgtggctgcaccatctgtcttcatccttccccgccatctgaatagcgtactctggagccgggctggccaaggcgcaatagnnnnnnnnnnnnnnnnnnnnnnnnnn

SEQ ID NO: 282397 - DNA, 169 bp, Homo sapiens
  misc_feature: GYAE6OF01EL3PP.1.24.C02.1.454.CMB.1.raw
  modified_base (157)..(169): a, c, t, g, unknown or other
  misc_feature (157)..(169): n is a, c, g, or t
tcagacgagtgcgtcacgaccggtgctcgatttagtacagatcgttagggcaagggaccaaggtggagatcaaacgaactgtggctgcaccatctgtcttcatccttcccgccatctgaatacgcgtactctggagcgggctggcaaggcgcatagnnnnnnnnnnnnn

SEQ ID NO: 282398 - DNA, 211 bp, Homo sapiens
  misc_feature: GYAE6OF01A68GC.1.24.C02.1.454.CMB.1.raw
  modified_base (170)..(211): a, c, t, g, unknown or other
  misc_feature (170)..(211): n is a, c, g, or t
tcagacgagtgcgtcacgaccggtgctcgatttagtacagatcgttagggcaagggaccaaggtggagatcaaaacgaactgtggctgcaccatctgtcttcatcttcccgcatctgaataggcgttactctaggacggcgggctgggacctaaagggccgataagtagnnnnnnnnnnnnnnnnnnnnnnnnnnnnnnnnnnnnnnnnnn

SEQ ID NO: 282399 - DNA, 160 bp, Homo sapiens
  misc_feature: GYAE6OF01DDBC6.1.24.C02.1.454.CMB.1.raw
  modified_base (156)..(160): a, c, t, g, unknown or other
  misc_feature (156)..(160): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgaggcgggctggcaaggcgacatagnnnnn

SEQ ID NO: 282400 - DNA, 225 bp, Homo sapiens
  misc_feature: GYAE6OF01BCOVI.1.24.C02.1.454.CMB.1.raw
  modified_base (170)..(225): a, c, t, g, unknown or other
  misc_feature (170)..(225): n is a, c, g, or t
tcagacgagtgcgtcacgaccggtgctcgatttagtacagatcgttaagggaaagggaccaaggtggagatcaaaacgaactgtggctgcaccatctgtcttcatccttcccgcatctgatatgtatactctggacggcggggctgggactaagggccgactaagtagannnnnnnnnnnnnnnnnnnnnnnnnnnnnnnnnnnnnnnnnnnnnnnnnnnnnnnn

SEQ ID NO: 282401 - DNA, 169 bp, Homo sapiens
  misc_feature: GYAE6OF01EFCGU.1.24.C02.1.454.CMB.1.raw
  modified_base (155)..(169): a, c, t, g, unknown or other
  misc_feature (155)..(169): n is a, c, g, or t
tcagacgagtgcgtcacgaccggtgctcgatttagtacagatcgttagggcaagggaccaaggtggagatcaaacgaactgtggctgcaccatctgtcttcatcttcccgccatcctgaatagcgtactctgagcgggctggcaaggcgcatagnnnnnnnnnnnnnnn

SEQ ID NO: 282402 - DNA, 165 bp, Homo sapiens
  misc_feature: GYAE6OF01BAN4I.1.24.C02.1.454.CMB.1.raw
  modified_base (152)..(165): a, c, t, g, unknown or other
  misc_feature (152)..(165): n is a, c, g, or t
tcagacgagtgcgtcacgaccggtgctcgatttagtacagatcgttagggcaagggaccaaggtggagatcaaacgaactgtggctgcaccatctgtcttcatcttccgccatctgaatagcgtactctgagcggctggcaaggcgcatagnnnnnnnnnnnnnn

SEQ ID NO: 282403 - DNA, 164 bp, Homo sapiens
  misc_feature: GYAE6OF01B0DQZ.1.24.C02.1.454.CMB.1.raw
  modified_base (151)..(151): a, c, t, g, unknown or other
  misc_feature (151)..(151): n is a, c, g, or t
  modified_base (156)..(164): a, c, t, g, unknown or other
  misc_feature (156)..(164): n is a, c, g, or t
tcagacgagtgcgtcacgaccggtgctcgatttagtacagatcgttagggcaagggaccaaggtggagatcaaacgaactgtggctgaaccatctgtcttcatccttcccgccatctagaatagcgtactctggagcgggctggcaaggcnatagnnnnnnnnn

SEQ ID NO: 282404 - DNA, 162 bp, Homo sapiens
  misc_feature: GYAE6OF01B8BEZ.1.24.C02.1.454.CMB.1.raw
  modified_base (153)..(162): a, c, t, g, unknown or other
  misc_feature (153)..(162): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaagcgtactctgaggcgggctggacaaggcgcatagnnnnnnnnnn

SEQ ID NO: 282405 - DNA, 161 bp, Homo sapiens
  misc_feature: GYAE6OF01D33Z4.1.24.C02.1.454.CMB.1.raw
  modified_base (150)..(161): a, c, t, g, unknown or other
  misc_feature (150)..(161): n is a, c, g, or t
tcagacgagtgcgtcacgaccggtgctcgatttagtacagatcgttagggcaagggaccaaggtggagatcaaacgaactgtggctgaaccatctgtcttcatcttcccgcatctgaatgctatctgagcgggctggcaaggcgcatagnnnnnnnnnnnn

SEQ ID NO: 282406 - DNA, 184 bp, Homo sapiens
  misc_feature: GYAE6OF01DZH0X.1.24.C02.1.454.CMB.1.raw
  modified_base (165)..(184): a, c, t, g, unknown or other
  misc_feature (165)..(184): n is a, c, g, or t
tcagacgagtgcgtcacgaccggtgctcgatttagtacagatcgttagggaaagggaccaaggtggagatacaaacgaactgtggctgcaccatctgtcttcatccttcccgcctatctgaaccgcactcgtctggacggcgggctggacaagggccgcaatagnnnnnnnnnnnnnnnnnnnn

SEQ ID NO: 282407 - DNA, 208 bp, Homo sapiens
  misc_feature: GYAE6OF01BMMM3.1.24.C02.1.454.CMB.1.raw
  modified_base (162)..(208): a, c, t, g, unknown or other
  misc_feature (162)..(208): n is a, c, g, or t
tcagacgagtgcgtcacgaccggtgctcgatttagtacagatcgttagggcaagggaccaaggtggagatcaaacgaactgtggctgcaccatctgtcttcatccttcccgcatctgaatagcgtactcgtgaggccgggtctggacaacgggcgcaagtgnnnnnnnnnnnnnnnnnnnnnnnnnnnnnnnnnnnnnnnnnnnnnnn

SEQ ID NO: 282408 - DNA, 185 bp, Homo sapiens
  misc_feature: GYAE6OF01BJV3G.1.24.C02.1.454.CMB.1.raw
  modified_base (126)..(126): a, c, t, g, unknown or other
  misc_feature (126)..(126): n is a, c, g, or t
  modified_base (146)..(146): a, c, t, g, unknown or other
  misc_feature (146)..(146): n is a, c, g, or t
  modified_base (152)..(154): a, c, t, g, unknown or other
  misc_feature (152)..(154): n is a, c, g, or t
  modified_base (156)..(160): a, c, t, g, unknown or other
  misc_feature (156)..(160): n is a, c, g, or t
  modified_base (162)..(185): a, c, t, g, unknown or other
  misc_feature (162)..(185): n is a, c, g, or t
tcagacgagtgcgtcacgaccggtgctcgatttagtacagatcgttagggaaagggaccaaggtggagatcaaacgactgtggctgcaccatctgtcttcatcttcccgcatctgaatagcgtacnctgagcgggctggcaaggcncatagnnntnnnnncnnnnnnnnnnnnnnnnnnnnnnnn

SEQ ID NO: 282409 - DNA, 177 bp, Homo sapiens
  misc_feature: GYAE6OF01CQGXQ.1.24.C02.1.454.CMB.1.raw
  modified_base (153)..(177): a, c, t, g, unknown or other
  misc_feature (153)..(177): n is a, c, g, or t
tcagacgagtgcgtcacgaccggtgctcgatttagtacagatcgttagggaaagggaccaaggtggagatcaaacgactgtggctgcaccatctgtcttcatcttcccgccatctgactatacgatcgctgagcgggctggcaagcgcatagnnnnnnnnnnnnnnnnnnnnnnnnn

SEQ ID NO: 282410 - DNA, 167 bp, Homo sapiens
  misc_feature: GYAE6OF01E1YQ4.1.24.C02.1.454.CMB.1.raw
  modified_base (148)..(148): a, c, t, g, unknown or other
  misc_feature (148)..(148): n is a, c, g, or t
  modified_base (154)..(167): a, c, t, g, unknown or other
  misc_feature (154)..(167): n is a, c, g, or t
tcagacgagtgcgtcacgaccggtgctcgatttagtacagatcgttagggaaagggaccaaggtggagatcaaacgaactgtggctgcaccatctgtcttcatccttcccgccatctgaacgcactcgtctgagcggctggcaaggcncatagnnnnnnnnnnnnnn

SEQ ID NO: 282411 - DNA, 174 bp, Homo sapiens
  misc_feature: GYAE6OF01B50MB.1.24.C02.1.454.CMB.1.raw
  modified_base (129)..(129): a, c, t, g, unknown or other
  misc_feature (129)..(129): n is a, c, g, or t
  modified_base (137)..(137): a, c, t, g, unknown or other
  misc_feature (137)..(137): n is a, c, g, or t
  modified_base (146)..(146): a, c, t, g, unknown or other
  misc_feature (146)..(146): n is a, c, g, or t
  modified_base (150)..(174): a, c, t, g, unknown or other
  misc_feature (150)..(174): n is a, c, g, or t
tcagacgagtgcgtcacgaccggtgctcgatttagtacagatcgttagggcaagggaccaaggtggagtatcaaacgactgtggctgcaccatctgtcttcatccttcccgcatctagatagcgtactntgagcggntgcaggtcnatgnnnnnnnnnnnnnnnnnnnnnnnnn

SEQ ID NO: 282412 - DNA, 236 bp, Homo sapiens
  misc_feature: GYAE6OF01EPQM7.1.24.C02.1.454.CMB.1.raw
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (176)..(236): a, c, t, g, unknown or other
  misc_feature (176)..(236): n is a, c, g, or t
tcagacgagtgcgtcacgaccggtgctcgattttagtacagatcgttaagggaaaagggaccaagggtggagatacaaaacgaactggtggctgcaaccatctgtcttcatccttcccgctagtctagaacgcacgtcgtctggacggcgggctaggaccgaaggcncaagtcntnnnnnnnnnnnnnnnnnnnnnnnnnnnnnnnnnnnnnnnnnnnnnnnnnnnnnnnnnnnnn

SEQ ID NO: 282413 - DNA, 162 bp, Homo sapiens
  misc_feature: GYAE6OF01B45H6.1.24.C02.1.454.CMB.1.raw
  modified_base (156)..(162): a, c, t, g, unknown or other
  misc_feature (156)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatatacgatcgctgaggcgggctggcaagggcactaatgnnnnnnn

SEQ ID NO: 282414 - DNA, 158 bp, Homo sapiens; identical to SEQ ID NO: 282361
  misc_feature: GYAE6OF01ECK30.1.24.C02.1.454.CMB.1.raw
  modified_base (154)..(158): a, c, t, g, unknown or other
  misc_feature (154)..(158): n is a, c, g, or t

SEQ ID NO: 282415 - DNA, 166 bp, Homo sapiens
  misc_feature: GYAE6OF01B4AOK.1.24.C02.1.454.CMB.1.raw
  modified_base (148)..(148): a, c, t, g, unknown or other
  misc_feature (148)..(148): n is a, c, g, or t
  modified_base (153)..(166): a, c, t, g, unknown or other
  misc_feature (153)..(166): n is a, c, g, or t
tcagacgagtgcgtcacgaccggtgctcgatttagtacagatcgttagggcaagggaccaaggtgtagatcaaaacgaactgtggctgcaccatctgtcttcatctcccgcatctgaatgcgtactgtgaggcgggctggcaagggcnaatgnnnnnnnnnnnnnn

SEQ ID NO: 282416 - DNA, 150 bp, Homo sapiens
  misc_feature: GYAE6OF02GLM30.1.24.C02.1.454.CMB.1.raw
  modified_base (150)..(150): a, c, t, g, unknown or other
  misc_feature (150)..(150): n is a, c, g, or t
tcagacgagtgcgtcacgaccggtgctcgatttagtacagatcgttaggcaaggaccaaggtggagatcaacgaactgtggctgcaccatctgtcttcatcttccgccatctgaatagcgtactctgagcgggctggcaaggcgcatagn

SEQ ID NO: 282417 - DNA, 154 bp, Homo sapiens; identical to SEQ ID NO: 281552
  misc_feature: GYAE6OF02GZOGK.1.24.C02.1.454.CMB.1.raw
  modified_base (154)..(154): a, c, t, g, unknown or other
  misc_feature (154)..(154): n is a, c, g, or t

SEQ ID NO: 282418 - DNA, 153 bp, Homo sapiens
  misc_feature: GYAE6OF02IQQFN.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttaggcaagggaccaaggtggagatcaaacgaactgtggctgcaccatctgtcttcatcttcccaccctcctcacgtagcgtgctgagcgggctggcaaggcgcatagn

SEQ ID NO: 282419 - DNA, 154 bp, Homo sapiens; identical to SEQ ID NO: 281552
  misc_feature: GYAE6OF02I2NSG.1.24.C02.1.454.CMB.1.raw
  modified_base (154)..(154): a, c, t, g, unknown or other
  misc_feature (154)..(154): n is a, c, g, or t

SEQ ID NO: 282420 - DNA, 150 bp, Homo sapiens
  misc_feature: GYAE6OF02JHH36.1.24.C02.1.454.CMB.1.raw
  modified_base (150)..(150): a, c, t, g, unknown or other
  misc_feature (150)..(150): n is a, c, g, or t
tcagacgagtgcgtcacgaccggtgctcgattagtacagatcgttaggcaagggaccaaggtggagatcaacgaactgtggctgcaccatctgtcttcatcttccgccatctgaatagcgtactctgagcgggctggcaaggcgcatagn

SEQ ID NO: 282421 - DNA, 155 bp, Homo sapiens
  misc_feature: GYAE6OF02H5JNA.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggcaaggaccaaggtggagatcaaacgaactgtggctgaaccatctgtcttcatcttcccgccatctgaatagcgtactctgagcgggctggcaaggcgcatagnnn

SEQ ID NO: 282422 - DNA, 178 bp, Homo sapiens
  misc_feature: GYAE6OF02IKSVT.1.24.C02.1.454.CMB.1.raw
  modified_base (158)..(178): a, c, t, g, unknown or other
  misc_feature (158)..(178): n is a, c, g, or t
tcagacgagtgcgtcacgaccggtgctcgatttagtacagatcgttaggcgtaagggaccaaggtggagatcaaacgaactgtggctgcaccatcctgtcttcagtcttcccgccatctgaatagccgtactctgagcgggctggcaaggcgcatagnnnnnnnnnnnnnnnnnnnnn

SEQ ID NO: 282423 - DNA, 151 bp, Homo sapiens
  misc_feature: GYAE6OF02G6VJL.1.24.C02.1.454.CMB.1.raw
  modified_base (150)..(151): a, c, t, g, unknown or other
  misc_feature (150)..(151): n is a, c, g, or t
tcagacgagtgcgtcacgaccggtgctcgatttagtacagatcgttaggcaaggaccaaggtggagatcaacgaactgtggctgcaccatctgtcttcatcttccgccatctgaatagcgtactctgagcgggctggcaaggcgcatagnn

SEQ ID NO: 282424 - DNA, 154 bp, Homo sapiens; identical to SEQ ID NO: 281641
  misc_feature: GYAE6OF02GWW11.1.24.C02.1.454.CMB.1.raw
  modified_base (154)..(154): a, c, t, g, unknown or other
  misc_feature (154)..(154): n is a, c, g, or t

SEQ ID NO: 282425 - DNA, 162 bp, Homo sapiens
  misc_feature: GYAE6OF02G8FMM.1.24.C02.1.454.CMB.1.raw
  modified_base (149)..(162): a, c, t, g, unknown or other
  misc_feature (149)..(162): n is a, c, g, or t
tcagacgagtgcgtcacgaccggtgctcgatttagtacagatcgttaggaaggaccaaggtggaatcaacgaactgtggctgcaccatcctgtcttcatcttccgccatctgatcgatcgcgtctgagcgggctggcaaggcgcatagnnnnnnnnnnnnnn

SEQ ID NO: 282426 - DNA, 153 bp, Homo sapiens
  misc_feature: GYAE6OF02G9GZU.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaagggaccaaggtggagatcaaacgaactgtggctgcaccatctgtcttcatcttcccacctcctcacgcactcgtctgagcgggctggcaaggcgcatagnn

SEQ ID NO: 282427 - DNA, 153 bp, Homo sapiens
  misc_feature: GYAE6OF02J4I8N.1.24.C02.1.454.CMB.1.raw
  modified_base (143)..(143): a, c, t, g, unknown or other
  misc_feature (143)..(143): n is a, c, g, or t
  modified_base (148)..(153): a, c, t, g, unknown or other
  misc_feature (148)..(153): n is a, c, g, or t
tcagacgagtgcgtcacgaccggtgctcgatttagtacagatcgttaggaaggaccaaggtggagatcaaacgactgtggctgcaccatctgtcttcatccttcccgcctctcacgtctactgctgaggcggctggcaaggcncatgnnnnnn

SEQ ID NO: 282428 - DNA, 167 bp, Homo sapiens
  misc_feature: GYAE6OF02GY5C3.1.24.C02.1.454.CMB.1.raw
  modified_base (163)..(167): a, c, t, g, unknown or other
  misc_feature (163)..(167): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgacggcggtcgtggacgaaggcgactaagtagnnnnn

SEQ ID NO: 282429 - DNA, 151 bp, Homo sapiens
  misc_feature: GYAE6OF02FNRDY.1.24.C02.1.454.CMB.1.raw
  modified_base (150)..(151): a, c, t, g, unknown or other
  misc_feature (150)..(151): n is a, c, g, or t
tcagacgagtgcgtcacgaccggtgctcgatttagtacagatcgttaggaaggaccaaggtggagatcaacgaactgtggctgcaccatctgtcttcatcttcccgccatctgatctctcgactctgagcgggctggcaaggcgcatagnn

SEQ ID NO: 282430 - DNA, 153 bp, Homo sapiens
  misc_feature: GYAE6OF02G84AW.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaaggaccaaggtggagatcaaacgaactgtggctgcaccatctgtcttcatcttcccgccatctgatatacgatcgctgagcgggctggcaaggcgcatagnn

SEQ ID NO: 282431 - DNA, 152 bp, Homo sapiens
  misc_feature: GYAE6OF02F5Y5W.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttaggcaagggaccaaggtggagatcaacgaactgtggctgcaccatctgtcttcatcttcccgccatctgaatagcgtactctgagcgggctggcaaggcgcatagn

SEQ ID NO: 282432 - DNA, 168 bp, Homo sapiens
  misc_feature: GYAE6OF02F0851.1.24.C02.1.454.CMB.1.raw
  modified_base (129)..(129): a, c, t, g, unknown or other
  misc_feature (129)..(129): n is a, c, g, or t
  modified_base (149)..(168): a, c, t, g, unknown or other
  misc_feature (149)..(168): n is a, c, g, or t
tcagacgagtgcgtcacgaccggtgctcgatttagtacagatcgttaggaagtgaccaaggtggagatcaactaactgtggctgcaccatctgtcttcatcttccgccatctgatcgtactgcgctgancggctggcaaggcgcatagnnnnnnnnnnnnnnnnnnnn

SEQ ID NO: 282433 - DNA, 153 bp, Homo sapiens; identical to SEQ ID NO: 281673
  misc_feature: GYAE6OF02FZESH.1.24.C02.1.454.CMB.1.raw
  modified_base (153)..(153): a, c, t, g, unknown or other
  misc_feature (153)..(153): n is a, c, g, or t

SEQ ID NO: 282434 - DNA, 151 bp, Homo sapiens
  misc_feature: GYAE6OF02HKKDU.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggaagggaccaaggtggaatcaacgaactgtggctgcaccatctgtcttcatcttcccgccatctgaacgcactcgtctgagcgggctggcaaggcgcatagn

SEQ ID NO: 282435 - DNA, 155 bp, Homo sapiens; identical to SEQ ID NO: 281555
  misc_feature: GYAE6OF02HLB7F.1.24.C02.1.454.CMB.1.raw
  modified_base (154)..(155): a, c, t, g, unknown or other
  misc_feature (154)..(155): n is a, c, g, or t

SEQ ID NO: 282436 - DNA, 154 bp, Homo sapiens; identical to SEQ ID NO: 281609
  misc_feature: GYAE6OF02GWRCM.1.24.C02.1.454.CMB.1.raw
  modified_base (154)..(154): a, c, t, g, unknown or other
  misc_feature (154)..(154): n is a, c, g, or t

SEQ ID NO: 282437 - DNA, 152 bp, Homo sapiens
  misc_feature: GYAE6OF02H0PHK.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaaagggaccaaggtggagatcaacgaactgtggctgcaccatctgtcttcatcttccgccatctgatcgtagcactctgagcgggctggcaaggcgcatagn

SEQ ID NO: 282438 - DNA, 154 bp, Homo sapiens; identical to SEQ ID NO: 281552
  misc_feature: GYAE6OF02HJ8IL.1.24.C02.1.454.CMB.1.raw
  modified_base (154)..(154): a, c, t, g, unknown or other
  misc_feature (154)..(154): n is a, c, g, or t

SEQ ID NO: 282439 - DNA, 155 bp, Homo sapiens; identical to SEQ ID NO: 281575
  misc_feature: GYAE6OF02GOEHX.1.24.C02.1.454.CMB.1.raw
  modified_base (154)..(155): a, c, t, g, unknown or other
  misc_feature (154)..(155): n is a, c, g, or t

SEQ ID NO: 282440 - DNA, 152 bp, Homo sapiens
  misc_feature: GYAE6OF02G2AMP.1.24.C02.1.454.CMB.1.raw
  modified_base (151)..(152): a, c, t, g, unknown or other
  misc_feature (151)..(152): n is a, c, g, or t
tcagacgagtgcgtcacgaccggtgctcgatttagtacagatcgttagggaaggaccaaggtggagatcaacgaactgtggctgcaccatctgtcttcatcttcccgccatctgatcgatcgcgtctgagcgggctggcaaggcgcatagnn

SEQ ID NO: 282441 - DNA, 200 bp, Homo sapiens
  misc_feature: GYAE6OF02IFEE0.1.24.C02.1.454.CMB.1.raw
  modified_base (158)..(200): a, c, t, g, unknown or other
  misc_feature (158)..(200): n is a, c, g, or t
tcagacgagtgcgtcacgaccggtgctcgatttagtacagatcgttagggcaagggaccaaggtggagatcgaaacgaactgtggctgcaccatctgtcttcatcttcccgccatctgaatagcgtactctgagcgggctggcaaggcgcactaggcnnnnnnnnnnnnnnnnnnnnnnnnnnnnnnnnnnnnnnnnnnn

SEQ ID NO: 282442 - DNA, 154 bp, Homo sapiens; identical to SEQ ID NO: 281552
  misc_feature: GYAE6OF02HMWZD.1.24.C02.1.454.CMB.1.raw
  modified_base (154)..(154): a, c, t, g, unknown or other
  misc_feature (154)..(154): n is a, c, g, or t

SEQ ID NO: 282443 - DNA, 153 bp, Homo sapiens
  misc_feature: GYAE6OF02HKN01.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgactcgcgatatctgagcgggctggcaaggcgcatagn

SEQ ID NO: 282444 - DNA, 153 bp, Homo sapiens; identical to SEQ ID NO: 281673
  misc_feature: GYAE6OF02GGRIB.1.24.C02.1.454.CMB.1.raw
  modified_base (153)..(153): a, c, t, g, unknown or other
  misc_feature (153)..(153): n is a, c, g, or t

SEQ ID NO: 282445 - DNA, 154 bp, Homo sapiens; identical to SEQ ID NO: 281552
  misc_feature: GYAE6OF02ISM38.1.24.C02.1.454.CMB.1.raw
  modified_base (154)..(154): a, c, t, g, unknown or other
  misc_feature (154)..(154): n is a, c, g, or t

SEQ ID NO: 282446 - DNA, 155 bp, Homo sapiens; identical to SEQ ID NO: 281555
  misc_feature: GYAE6OF02HBFAF.1.24.C02.1.454.CMB.1.raw
  modified_base (154)..(155): a, c, t, g, unknown or other
  misc_feature (154)..(155): n is a, c, g, or t

SEQ ID NO: 282447 - DNA, 154 bp, Homo sapiens; identical to SEQ ID NO: 281552
  misc_feature: GYAE6OF02HG67S.1.24.C02.1.454.CMB.1.raw
  modified_base (154)..(154): a, c, t, g, unknown or other
  misc_feature (154)..(154): n is a, c, g, or t

SEQ ID NO: 282448 - DNA, 162 bp, Homo sapiens
  misc_feature: GYAE6OF02HOJGW.1.24.C02.1.454.CMB.1.raw
  modified_base (153)..(162): a, c, t, g, unknown or other
  misc_feature (153)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgtctactgctgagcggctggcaaggcgcatagnnnnnnnnnn

SEQ ID NO: 282449 - DNA, 154 bp, Homo sapiens; identical to SEQ ID NO: 281552
  misc_feature: GYAE6OF02H8IG3.1.24.C02.1.454.CMB.1.raw
  modified_base (154)..(154): a, c, t, g, unknown or other
  misc_feature (154)..(154): n is a, c, g, or t

SEQ ID NO: 282450 - DNA, 153 bp, Homo sapiens; identical to SEQ ID NO: 281673
  misc_feature: GYAE6OF02GG3GF.1.24.C02.1.454.CMB.1.raw
  modified_base (153)..(153): a, c, t, g, unknown or other
  misc_feature (153)..(153): n is a, c, g, or t

SEQ ID NO: 282451 - DNA, 154 bp, Homo sapiens; identical to SEQ ID NO: 281641
  misc_feature: GYAE6OF02GJS6O.1.24.C02.1.454.CMB.1.raw
  modified_base (154)..(154): a, c, t, g, unknown or other
  misc_feature (154)..(154): n is a, c, g, or t

SEQ ID NO: 282452 - DNA, 155 bp, Homo sapiens; identical to SEQ ID NO: 281978
  misc_feature: GYAE6OF02HZ09Q.1.24.C02.1.454.CMB.1.raw
  modified_base (154)..(155): a, c, t, g, unknown or other
  misc_feature (154)..(155): n is a, c, g, or t

SEQ ID NO: 282453 - DNA, 154 bp, Homo sapiens; identical to SEQ ID NO: 281607
  misc_feature: GYAE6OF02I0G67.1.24.C02.1.454.CMB.1.raw
  modified_base (154)..(154): a, c, t, g, unknown or other
  misc_feature (154)..(154): n is a, c, g, or t

SEQ ID NO: 282454 - DNA, 154 bp, Homo sapiens
  misc_feature: GYAE6OF02F97BN.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaagtgaccaaggtggagatcaaactaactgtggctgcaccatctgtcttcatcttcccgccatctgatcgtactgcgctgagcgggctggcaaggcgcatagnn

SEQ ID NO: 282455 - DNA, 154 bp, Homo sapiens; identical to SEQ ID NO: 281771
  misc_feature: GYAE6OF02F8ZUB.1.24.C02.1.454.CMB.1.raw
  modified_base (154)..(154): a, c, t, g, unknown or other
  misc_feature (154)..(154): n is a, c, g, or t

SEQ ID NO: 282456 - DNA, 158 bp, Homo sapiens; identical to SEQ ID NO: 281713
  misc_feature: GYAE6OF02G4WSU.1.24.C02.1.454.CMB.1.raw
  modified_base (154)..(158): a, c, t, g, unknown or other
  misc_feature (154)..(158): n is a, c, g, or t

SEQ ID NO: 282457 - DNA, 154 bp, Homo sapiens; identical to SEQ ID NO: 281677
  misc_feature: GYAE6OF02GYC0K.1.24.C02.1.454.CMB.1.raw
  modified_base (153)..(154): a, c, t, g, unknown or other
  misc_feature (153)..(154): n is a, c, g, or t

SEQ ID NO: 282458 - DNA, 154 bp, Homo sapiens
  misc_feature: GYAE6OF02IUDGE.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaagggaccaaggtggagatcaaacgaactgttgctgcaccatctgtcttcatcttcccgccatctgatcgtagcactctgagcgggctggcaaggcgcatagnn

SEQ ID NO: 282459 - DNA, 155 bp, Homo sapiens; identical to SEQ ID NO: 281555
  misc_feature: GYAE6OF02F7OIY.1.24.C02.1.454.CMB.1.raw
  modified_base (154)..(155): a, c, t, g, unknown or other
  misc_feature (154)..(155): n is a, c, g, or t

SEQ ID NO: 282460 - DNA, 154 bp, Homo sapiens; identical to SEQ ID NO: 281681
  misc_feature: GYAE6OF02IGRHA.1.24.C02.1.454.CMB.1.raw
  modified_base (154)..(154): a, c, t, g, unknown or other
  misc_feature (154)..(154): n is a, c, g, or t

SEQ ID NO: 282461 - DNA, 155 bp, Homo sapiens; identical to SEQ ID NO: 281675
  misc_feature: GYAE6OF02HX3J8.1.24.C02.1.454.CMB.1.raw
  modified_base (154)..(155): a, c, t, g, unknown or other
  misc_feature (154)..(155): n is a, c, g, or t

SEQ ID NO: 282462 - DNA, 156 bp, Homo sapiens; identical to SEQ ID NO: 281661
  misc_feature: GYAE6OF02I4WYL.1.24.C02.1.454.CMB.1.raw
  modified_base (154)..(156): a, c, t, g, unknown or other
  misc_feature (154)..(156): n is a, c, g, or t

SEQ ID NO: 282463 - DNA, 155 bp, Homo sapiens; identical to SEQ ID NO: 281591
  misc_feature: GYAE6OF02HGZHV.1.24.C02.1.454.CMB.1.raw
  modified_base (154)..(155): a, c, t, g, unknown or other
  misc_feature (154)..(155): n is a, c, g, or t

SEQ ID NO: 282464 - DNA, 155 bp, Homo sapiens; identical to SEQ ID NO: 281555
  misc_feature: GYAE6OF02GHP9K.1.24.C02.1.454.CMB.1.raw
  modified_base (154)..(155): a, c, t, g, unknown or other
  misc_feature (154)..(155): n is a, c, g, or t

SEQ ID NO: 282465 - DNA, 153 bp, Homo sapiens; identical to SEQ ID NO: 282002
  misc_feature: GYAE6OF02IG13Z.1.24.C02.1.454.CMB.1.raw

SEQ ID NO: 282466 - DNA, 152 bp, Homo sapiens
  misc_feature: GYAE6OF02HMVHD.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttaggcaagggaccaaggtgtagatcaaacgaactgtggctgcaccatctgtcttcatcttcccgccatctgaatagcgtactctgagcggctggcaaggcgcatagn

SEQ ID NO: 282467 - DNA, 155 bp, Homo sapiens; identical to SEQ ID NO: 281555
  misc_feature: GYAE6OF02H493B.1.24.C02.1.454.CMB.1.raw
  modified_base (154)..(155): a, c, t, g, unknown or other
  misc_feature (154)..(155): n is a, c, g, or t

SEQ ID NO: 282468 - DNA, 154 bp, Homo sapiens; identical to SEQ ID NO: 281904
  misc_feature: GYAE6OF02HDB36.1.24.C02.1.454.CMB.1.raw
  modified_base (154)..(154): a, c, t, g, unknown or other
  misc_feature (154)..(154): n is a, c, g, or t

SEQ ID NO: 282469 - DNA, 152 bp, Homo sapiens
  misc_feature: GYAE6OF02F430C.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaagggaccaaggtggagatcaaacgaactgtggctgcaccatctgtcttcatcttccgccatctgatatgtatactctgagcgggctggcaaggcgcatagn

SEQ ID NO: 282470 - DNA, 154 bp, Homo sapiens; identical to SEQ ID NO: 281552
  misc_feature: GYAE6OF02GBJPQ.1.24.C02.1.454.CMB.1.raw
  modified_base (154)..(154): a, c, t, g, unknown or other
  misc_feature (154)..(154): n is a, c, g, or t

SEQ ID NO: 282471 - DNA, 154 bp, Homo sapiens; identical to SEQ ID NO: 281604
  misc_feature: GYAE6OF02GPLCX.1.24.C02.1.454.CMB.1.raw
  modified_base (154)..(154): a, c, t, g, unknown or other
  misc_feature (154)..(154): n is a, c, g, or t

SEQ ID NO: 282472 - DNA, 154 bp, Homo sapiens; identical to SEQ ID NO: 281569
  misc_feature: GYAE6OF02F7AIK.1.24.C02.1.454.CMB.1.raw
  modified_base (154)..(154): a, c, t, g, unknown or other
  misc_feature (154)..(154): n is a, c, g, or t

SEQ ID NO: 282473 - DNA, 153 bp, Homo sapiens
  misc_feature: GYAE6OF02ITDIQ.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaatagcgtactctgagcgggctggcaaggcgcatagn

SEQ ID NO: 282474 - DNA, 154 bp, Homo sapiens; identical to SEQ ID NO: 281552
  misc_feature: GYAE6OF02I5PG0.1.24.C02.1.454.CMB.1.raw
  modified_base (154)..(154): a, c, t, g, unknown or other
  misc_feature (154)..(154): n is a, c, g, or t

SEQ ID NO: 282475 - DNA, 154 bp, Homo sapiens; identical to SEQ ID NO: 281614
  misc_feature: GYAE6OF02H3Y2I.1.24.C02.1.454.CMB.1.raw
  modified_base (154)..(154): a, c, t, g, unknown or other
  misc_feature (154)..(154): n is a, c, g, or t

SEQ ID NO: 282476 - DNA, 154 bp, Homo sapiens; identical to SEQ ID NO: 281968
  misc_feature: GYAE6OF02G9881.1.24.C02.1.454.CMB.1.raw
  modified_base (154)..(154): a, c, t, g, unknown or other
  misc_feature (154)..(154): n is a, c, g, or t

SEQ ID NO: 282477 - DNA, 154 bp, Homo sapiens; identical to SEQ ID NO: 281552
  misc_feature: GYAE6OF02GBOSD.1.24.C02.1.454.CMB.1.raw
  modified_base (154)..(154): a, c, t, g, unknown or other
  misc_feature (154)..(154): n is a, c, g, or t

SEQ ID NO: 282478 - DNA, 155 bp, Homo sapiens; identical to SEQ ID NO: 281575
  misc_feature: GYAE6OF02I1PFW.1.24.C02.1.454.CMB.1.raw
  modified_base (154)..(155): a, c, t, g, unknown or other
  misc_feature (154)..(155): n is a, c, g, or t

SEQ ID NO: 282479 - DNA, 154 bp, Homo sapiens; identical to SEQ ID NO: 281681
  misc_feature: GYAE6OF02IS203.1.24.C02.1.454.CMB.1.raw
  modified_base (154)..(154): a, c, t, g, unknown or other
  misc_feature (154)..(154): n is a, c, g, or t

SEQ ID NO: 282480 - DNA, 154 bp, Homo sapiens; identical to SEQ ID NO: 281572
  misc_feature: GYAE6OF02FT7TO.1.24.C02.1.454.CMB.1.raw
  modified_base (154)..(154): a, c, t, g, unknown or other
  misc_feature (154)..(154): n is a, c, g, or t

SEQ ID NO: 282481 - DNA, 154 bp, Homo sapiens
  misc_feature: GYAE6OF02GLK4X.1.24.C02.1.454.CMB.1.raw
  modified_base (152)..(154): a, c, t, g, unknown or other
  misc_feature (152)..(154): n is a, c, g, or t
tcagacgagtgcgtcacgaccggtgctcgatttagtacagatcgttagggaagggaccaaggtggagatcaaacgaactgtggctgcaccatctgtcttcatctcccgccatctgatatacgatcgctgagcgggctggcaaggcgcatagnnn

SEQ ID NO: 282482 - DNA, 193 bp, Homo sapiens
  misc_feature: GYAE6OF02ISTAD.1.24.C02.1.454.CMB.1.raw
  modified_base (155)..(193): a, c, t, g, unknown or other
  misc_feature (155)..(193): n is a, c, g, or t
tcagacgagtgcgtcacgaccggtgctcgatttagtacagatcgttagggaaagggaccaaggtggagagtcaaacgaactgttgctgcaccgatctgtcttcatcttcccgccatctgatcgtagcactctgagcggctggcaaggcgcatagnnnnnnnnnnnnnnnnnnnnnnnnnnnnnnnnnnnnnnn

SEQ ID NO: 282483 - DNA, 155 bp, Homo sapiens; identical to SEQ ID NO: 281675
  misc_feature: GYAE6OF02GZYNW.1.24.C02.1.454.CMB.1.raw
  modified_base (154)..(155): a, c, t, g, unknown or other
  misc_feature (154)..(155): n is a, c, g, or t

SEQ ID NO: 282484 - DNA, 170 bp, Homo sapiens
  misc_feature: GYAE6OF02HUQGJ.1.24.C02.1.454.CMB.1.raw
  modified_base (154)..(170): a, c, t, g, unknown or other
  misc_feature (154)..(170): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnnnnnnnnnnnnnnnn

SEQ ID NO: 282485 - DNA, 156 bp, Homo sapiens; identical to SEQ ID NO: 281741
  misc_feature: GYAE6OF02GK2ZB.1.24.C02.1.454.CMB.1.raw
  modified_base (154)..(156): a, c, t, g, unknown or other
  misc_feature (154)..(156): n is a, c, g, or t

SEQ ID NO: 282486 - DNA, 206 bp, Homo sapiens
  misc_feature: GYAE6OF02HO5RC.1.24.C02.1.454.CMB.1.raw
  modified_base (148)..(206): a, c, t, g, unknown or other
  misc_feature (148)..(206): n is a, c, g, or t
tcagacgagtgcgtcacgaccggtgctcgatttagtacagatcgttaggcaaggaccaaggtggagatcaaacgactgtggctgcaccatctgtcttcatcttccgcatctgaatagcgtactctgagcggctggcaaggcgcatagnnnnnnnnnnnnnnnnnnnnnnnnnnnnnnnnnnnnnnnnnnnnnnnnnnnnnnnnnnn

SEQ ID NO: 282487 - DNA, 154 bp, Homo sapiens; identical to SEQ ID NO: 281783
  misc_feature: GYAE6OF02IUQOI.1.24.C02.1.454.CMB.1.raw
  modified_base (154)..(154): a, c, t, g, unknown or other
  misc_feature (154)..(154): n is a, c, g, or t

SEQ ID NO: 282488 - DNA, 154 bp, Homo sapiens; identical to SEQ ID NO: 281569
  misc_feature: GYAE6OF02IIGRC.1.24.C02.1.454.CMB.1.raw
  modified_base (154)..(154): a, c, t, g, unknown or other
  misc_feature (154)..(154): n is a, c, g, or t

SEQ ID NO: 282489 - DNA, 154 bp, Homo sapiens; identical to SEQ ID NO: 281604
  misc_feature: GYAE6OF02HYE7N.1.24.C02.1.454.CMB.1.raw
  modified_base (154)..(154): a, c, t, g, unknown or other
  misc_feature (154)..(154): n is a, c, g, or t

SEQ ID NO: 282490 - DNA, 153 bp, Homo sapiens
  misc_feature: GYAE6OF02F8D2T.1.24.C02.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacagatcgttagggaaggaccaaggtggagatcaaacgaactgtggctgcaccatctgtcttcatcttcccgccctcctcacgtctactgctgagcgggctggcaaggcgcatagnn

SEQ ID NO: 282491 - DNA, 204 bp, Homo sapiens
  misc_feature: GYAE6OF02JD2BT.1.24.C02.1.454.CMB.1.raw
  modified_base (162)..(204): a, c, t, g, unknown or other
  misc_feature (162)..(204): n is a, c, g, or t
tcagacgagtgcgtcacgaccggtgctcgatttagtacagatcgttagggcgtaagggaccaaggttggagatcaaacgaactgtggctgcaccatctgtcttcagtcttcccgccatctgaatagtcgtactctgagcgggctggcaaggcgcaatagcannnnnnnnnnnnnnnnnnnnnnnnnnnnnnnnnnnnnnnnnnn

SEQ ID NO: 282492 - DNA, 155 bp, Homo sapiens; identical to SEQ ID NO: 281753
  misc_feature: GYAE6OF02HXV25.1.24.C02.1.454.CMB.1.raw
  modified_base (154)..(155): a, c, t, g, unknown or other
  misc_feature (154)..(155): n is a, c, g, or t

SEQ ID NO: 282493 - DNA, 162 bp, Homo sapiens
  misc_feature: GYAE6OF02GRRO8.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagnnnnnnnnn

SEQ ID NO: 282494 - DNA, 195 bp, Homo sapiens
  misc_feature: GYAE6OF02IUAPA.1.24.C02.1.454.CMB.1.raw
  modified_base (159)..(160): a, c, t, g, unknown or other
  misc_feature (159)..(160): n is a, c, g, or t
  modified_base (162)..(195): a, c, t, g, unknown or other
  misc_feature (162)..(195): n is a, c, g, or t
tcagacgagtgcgtcacgaccggtgctcgatttagtacagatcgttagggcgtaagggaccaaggttggagatcaaacgaactgtggctgcaccatcctgtcttcatcttccgccatctgaatagcgtactctgagcgggctggcaaggcgcaatagcnncnnnnnnnnnnnnnnnnnnnnnnnnnnnnnnnnnn

SEQ ID NO: 282495 - DNA, 160 bp, Homo sapiens
  misc_feature: GYAE6OF02GTTAJ.1.24.C02.1.454.CMB.1.raw
  modified_base (155)..(160): a, c, t, g, unknown or other
  misc_feature (155)..(160): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnnnn

SEQ ID NO: 282496 - DNA, 154 bp, Homo sapiens; identical to SEQ ID NO: 281706
  misc_feature: GYAE6OF02GFPRD.1.24.C02.1.454.CMB.1.raw
  modified_base (154)..(154): a, c, t, g, unknown or other
  misc_feature (154)..(154): n is a, c, g, or t

SEQ ID NO: 282497 - DNA, 154 bp, Homo sapiens; identical to SEQ ID NO: 281552
  misc_feature: GYAE6OF02IPK2R.1.24.C02.1.454.CMB.1.raw
  modified_base (154)..(154): a, c, t, g, unknown or other
  misc_feature (154)..(154): n is a, c, g, or t

SEQ ID NO: 282498 - DNA, 154 bp, Homo sapiens; identical to SEQ ID NO: 281569
  misc_feature: GYAE6OF02GSZFD.1.24.C02.1.454.CMB.1.raw
  modified_base (154)..(154): a, c, t, g, unknown or other
  misc_feature (154)..(154): n is a, c, g, or t

SEQ ID NO: 282499 - DNA, 174 bp, Homo sapiens
  misc_feature: GYAE6OF02I1ESS.1.24.C02.1.454.CMB.1.raw
  modified_base (157)..(174): a, c, t, g, unknown or other
  misc_feature (157)..(174): n is a, c, g, or t
tcagacgagtgcgtcacgaccggtgctcgatttagtacagatcgttagggcgaagggaccgaaggtggagatcaaacgaactgtggctgcaccatctgtcttcatcttcccgccatcctgaatagcgtactctgagcgggctggcaaggcgcatagnnnnnnnnnnnnnnnnnn

SEQ ID NO: 282500 - DNA, 167 bp, Homo sapiens
  misc_feature: GYAE6OF02GQ5FY.1.24.C02.1.454.CMB.1.raw
  modified_base (154)..(167): a, c, t, g, unknown or other
  misc_feature (154)..(167): n is a, c, g, or t
tcagacgagtgcgtcacgaccggtgctcgatttagtacagatcgttagggcgaagggaccaaggtggagatcaaacgaactgtggctgaaccatctgtcttcatcttccgccatctgaatagcgtactctgagcgggctggcaaggcgcatagnnnnnnnnnnnnnn

SEQ ID NO: 282501 - DNA, 151 bp, Homo sapiens
  misc_feature: GYAE6OF02HSI0D.1.24.C02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtacagatcgttagggcaagggaccaaggtgtagatcaaacgaactgtggctgcaccatctgtcttcatcccgccatctgaatagcgtactctgagcgggctggcaaggcgcatagn

SEQ ID NO: 282502 - DNA, 154 bp, Homo sapiens
  misc_feature: GYAE6OF02F7PV2.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaagggaccaaggtggagatcaaacgaactgtggctgcaccatctgtcttcatcttcccaccctcctctcgtactgcgctgagcgggctggcaaggcgcatagnn

SEQ ID NO: 282503 - DNA, 164 bp, Homo sapiens
  misc_feature: GYAE6OF02HPAD2.1.24.C02.1.454.CMB.1.raw
  modified_base (156)..(164): a, c, t, g, unknown or other
  misc_feature (156)..(164): n is a, c, g, or t
tcagacgagtgcgtcacgaccggtgctcgatttagtacagatcgttagggcgaagggaccgaaggtggagatcaaacgaactgtggctgcaccatctgtcttcatcttcccgccatctgaatagcgtactctgagcgggctggcaaggcgcatagnnnnnnnnn

SEQ ID NO: 282504 - DNA, 154 bp, Homo sapiens; identical to SEQ ID NO: 281598
  misc_feature: GYAE6OF02IFV0C.1.24.C02.1.454.CMB.1.raw
  modified_base (154)..(154): a, c, t, g, unknown or other
  misc_feature (154)..(154): n is a, c, g, or t

SEQ ID NO: 282505 - DNA, 154 bp, Homo sapiens; identical to SEQ ID NO: 281552
  misc_feature: GYAE6OF02FJLR2.1.24.C02.1.454.CMB.1.raw
  modified_base (154)..(154): a, c, t, g, unknown or other
  misc_feature (154)..(154): n is a, c, g, or t

SEQ ID NO: 282506 - DNA, 154 bp, Homo sapiens
  misc_feature: GYAE6OF02JWC2U.1.24.C02.1.454.CMB.1.raw
  modified_base (151)..(154): a, c, t, g, unknown or other
  misc_feature (151)..(154): n is a, c, g, or t
tcagacgagtgcgtcacgaccggtgctcgatttagtacagatcgttaggaagggaccaaggtggagatcaacgaactgtggctgcaccatctgtcttcatcttcccgccatctgactcgcgatatctgagcgggctggcaaggcgcatagnnnn

SEQ ID NO: 282507 - DNA, 154 bp, Homo sapiens; identical to SEQ ID NO: 281572
  misc_feature: GYAE6OF02G6YMT.1.24.C02.1.454.CMB.1.raw
  modified_base (154)..(154): a, c, t, g, unknown or other
  misc_feature (154)..(154): n is a, c, g, or t

SEQ ID NO: 282508 - DNA, 176 bp, Homo sapiens
  misc_feature: GYAE6OF02GH8LZ.1.24.C02.1.454.CMB.1.raw
  modified_base (154)..(176): a, c, t, g, unknown or other
  misc_feature (154)..(176): n is a, c, g, or t
tcagacgagtgcgtcacgaccggtgctcgatttagtacagatcgttagggaagtgaccaaggtggagatcaaactaactgtggctgcaccatctgtcttcatcttcccgccatctgatcgtactgcgctgagcgggctggcaaggcgcagtagnnnnnnnnnnnnnnnnnnnnnnn

SEQ ID NO: 282509 - DNA, 155 bp, Homo sapiens
  misc_feature: GYAE6OF02GH549.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggaagtgaccaaggtggagatcaaactaactgtggctgcaccatctgtcttcatcttcccgccatctgatcgtactgcgctgagcgggctggcaaggcgcatagnnn

SEQ ID NO: 282510 - DNA, 154 bp, Homo sapiens; identical to SEQ ID NO: 281607
  misc_feature: GYAE6OF02HKG00.1.24.C02.1.454.CMB.1.raw
  modified_base (154)..(154): a, c, t, g, unknown or other
  misc_feature (154)..(154): n is a, c, g, or t

SEQ ID NO: 282511 - DNA, 155 bp, Homo sapiens; identical to SEQ ID NO: 281555
  misc_feature: GYAE6OF02GZ50Z.1.24.C02.1.454.CMB.1.raw
  modified_base (154)..(155): a, c, t, g, unknown or other
  misc_feature (154)..(155): n is a, c, g, or t

SEQ ID NO: 282512 - DNA, 155 bp, Homo sapiens; identical to SEQ ID NO: 281555
  misc_feature: GYAE6OF02HKCZE.1.24.C02.1.454.CMB.1.raw
  modified_base (154)..(155): a, c, t, g, unknown or other
  misc_feature (154)..(155): n is a, c, g, or t

SEQ ID NO: 282513 - DNA, 156 bp, Homo sapiens; identical to SEQ ID NO: 281741
  misc_feature: GYAE6OF02FJEG4.1.24.C02.1.454.CMB.1.raw
  modified_base (154)..(156): a, c, t, g, unknown or other
  misc_feature (154)..(156): n is a, c, g, or t

SEQ ID NO: 282514 - DNA, 160 bp, Homo sapiens
  misc_feature: GYAE6OF02IXV7E.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatcgtagcactctgagcgggctggcaaggcgcatagnnnnnnn

SEQ ID NO: 282515 - DNA, 162 bp, Homo sapiens
  misc_feature: GYAE6OF02HCEL6.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcatagnnnnnnnnn

SEQ ID NO: 282516 - DNA, 154 bp, Homo sapiens; identical to SEQ ID NO: 281569
  misc_feature: GYAE6OF02HYCZN.1.24.C02.1.454.CMB.1.raw
  modified_base (154)..(154): a, c, t, g, unknown or other
  misc_feature (154)..(154): n is a, c, g, or t

SEQ ID NO: 282517 - DNA, 175 bp, Homo sapiens
  misc_feature: GYAE6OF02IC6FR.1.24.C02.1.454.CMB.1.raw
  modified_base (157)..(175): a, c, t, g, unknown or other
  misc_feature (157)..(175): n is a, c, g, or t
tcagacgagtgcgtcacgaccggtgctcgatttagtacagatcgttagggcaaaggggaccaaggtggagatcaaacgaacctgtggctgcaccatctgtcttcatcttcccgccatctgaatagcgtactctgagcgggctggcaaggcgcatagnnnnnnnnnnnnnnnnnnn

SEQ ID NO: 282518 - DNA, 154 bp, Homo sapiens; identical to SEQ ID NO: 281572
  misc_feature: GYAE6OF02IYF4K.1.24.C02.1.454.CMB.1.raw
  modified_base (154)..(154): a, c, t, g, unknown or other
  misc_feature (154)..(154): n is a, c, g, or t

SEQ ID NO: 282519 - DNA, 154 bp, Homo sapiens; identical to SEQ ID NO: 281572
  misc_feature: GYAE6OF02HK9XA.1.24.C02.1.454.CMB.1.raw
  modified_base (154)..(154): a, c, t, g, unknown or other
  misc_feature (154)..(154): n is a, c, g, or t

SEQ ID NO: 282520 - DNA, 163 bp, Homo sapiens
  misc_feature: GYAE6OF02F4TFC.1.24.C02.1.454.CMB.1.raw
  modified_base (154)..(163): a, c, t, g, unknown or other
  misc_feature (154)..(163): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnnnnnnnnn

SEQ ID NO: 282521 - DNA, 154 bp, Homo sapiens; identical to SEQ ID NO: 281644
  misc_feature: GYAE6OF02H8JQX.1.24.C02.1.454.CMB.1.raw
  modified_base (154)..(154): a, c, t, g, unknown or other
  misc_feature (154)..(154): n is a, c, g, or t

SEQ ID NO: 282522 - DNA, 157 bp, Homo sapiens
  misc_feature: GYAE6OF02GCZKL.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgcatagnnnn

SEQ ID NO: 282523 - DNA, 154 bp, Homo sapiens; identical to SEQ ID NO: 281644
  misc_feature: GYAE6OF02G0B4B.1.24.C02.1.454.CMB.1.raw
  modified_base (154)..(154): a, c, t, g, unknown or other
  misc_feature (154)..(154): n is a, c, g, or t

SEQ ID NO: 282524 - DNA, 172 bp, Homo sapiens
  misc_feature: GYAE6OF02F11V0.1.24.C02.1.454.CMB.1.raw
  modified_base (156)..(172): a, c, t, g, unknown or other
  misc_feature (156)..(172): n is a, c, g, or t
tcagacgagtgcgtcacgaccggtgctcgatttagtacagatcgttagggaaaggtgaccaaggtggagatcaaactaactgtggctgcaccatctgtcttcatcttcccgccatctgatcgtactgcgctgagcgggcttggcaaggcgcatagnnnnnnnnnnnnnnnnn

SEQ ID NO: 282525 - DNA, 156 bp, Homo sapiens
  misc_feature: GYAE6OF02GHWVN.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaacgtctactgctgagcgggctggcaaggcgcatagnnn

SEQ ID NO: 282526 - DNA, 153 bp, Homo sapiens; identical to SEQ ID NO: 282473
  misc_feature: GYAE6OF02H19K1.1.24.C02.1.454.CMB.1.raw
  modified_base (153)..(153): a, c, t, g, unknown or other
  misc_feature (153)..(153): n is a, c, g, or t

SEQ ID NO: 282527 - DNA, 155 bp, Homo sapiens; identical to SEQ ID NO: 281555
  misc_feature: GYAE6OF02JDPFK.1.24.C02.1.454.CMB.1.raw
  modified_base (154)..(155): a, c, t, g, unknown or other
  misc_feature (154)..(155): n is a, c, g, or t

SEQ ID NO: 282528 - DNA, 154 bp, Homo sapiens; identical to SEQ ID NO: 281771
  misc_feature: GYAE6OF02GHCFZ.1.24.C02.1.454.CMB.1.raw
  modified_base (154)..(154): a, c, t, g, unknown or other
  misc_feature (154)..(154): n is a, c, g, or t

SEQ ID NO: 282529 - DNA, 154 bp, Homo sapiens; identical to SEQ ID NO: 281604
  misc_feature: GYAE6OF02G0PPB.1.24.C02.1.454.CMB.1.raw
  modified_base (154)..(154): a, c, t, g, unknown or other
  misc_feature (154)..(154): n is a, c, g, or t

SEQ ID NO: 282530 - DNA, 156 bp, Homo sapiens; identical to SEQ ID NO: 281762
  misc_feature: GYAE6OF02GXCXL.1.24.C02.1.454.CMB.1.raw
  modified_base (154)..(156): a, c, t, g, unknown or other
  misc_feature (154)..(156): n is a, c, g, or t

SEQ ID NO: 282531 - DNA, 161 bp, Homo sapiens; identical to SEQ ID NO: 281600
  misc_feature: GYAE6OF02IDWJP.1.24.C02.1.454.CMB.1.raw
  modified_base (154)..(161): a, c, t, g, unknown or other
  misc_feature (154)..(161): n is a, c, g, or t

SEQ ID NO: 282532 - DNA, 154 bp, Homo sapiens; identical to SEQ ID NO: 281552
  misc_feature: GYAE6OF02HMHJD.1.24.C02.1.454.CMB.1.raw
  modified_base (154)..(154): a, c, t, g, unknown or other
  misc_feature (154)..(154): n is a, c, g, or t

SEQ ID NO: 282533 - DNA, 154 bp, Homo sapiens; identical to SEQ ID NO: 281552
  misc_feature: GYAE6OF02H63TF.1.24.C02.1.454.CMB.1.raw
  modified_base (154)..(154): a, c, t, g, unknown or other
  misc_feature (154)..(154): n is a, c, g, or t

SEQ ID NO: 282534 - DNA, 155 bp, Homo sapiens; identical to SEQ ID NO: 281555
  misc_feature: GYAE6OF02HXVUC.1.24.C02.1.454.CMB.1.raw
  modified_base (154)..(155): a, c, t, g, unknown or other
  misc_feature (154)..(155): n is a, c, g, or t

SEQ ID NO: 282535 - DNA, 189 bp, Homo sapiens
  misc_feature: GYAE6OF02H3SHN.1.24.C02.1.454.CMB.1.raw
  modified_base (154)..(189): a, c, t, g, unknown or other
  misc_feature (154)..(189): n is a, c, g, or t
tcagacgagtgcgtcacgaccggtgctcgatttagtacagatcgttagggaaagggaccaaggtggagatcaaacgaactgtggcctgcaccatctgtcttcatcttcccgccctcctcacgcactcgctgagcgggctggcaaggcgcatagnnnnnnnnnnnnnnnnnnnnnnnnnnnnnnnnnnnn

SEQ ID NO: 282536 - DNA, 154 bp, Homo sapiens; identical to SEQ ID NO: 282454
  misc_feature: GYAE6OF02HNJ9C.1.24.C02.1.454.CMB.1.raw
  modified_base (153)..(154): a, c, t, g, unknown or other
  misc_feature (153)..(154): n is a, c, g, or t

SEQ ID NO: 282537 - DNA, 154 bp, Homo sapiens
  misc_feature: GYAE6OF02F7N1H.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagtgcaagggaccaaggtggagatcaaacgaactgtggctgcaccatctgtcttcatcttccgccatctgactcgtctctactgagcgggctggcaaggcgcatagnn

SEQ ID NO: 282538 - DNA, 154 bp, Homo sapiens; identical to SEQ ID NO: 281552
  misc_feature: GYAE6OF02GJFXB.1.24.C02.1.454.CMB.1.raw
  modified_base (154)..(154): a, c, t, g, unknown or other
  misc_feature (154)..(154): n is a, c, g, or t

SEQ ID NO: 282539 - DNA, 154 bp, Homo sapiens; identical to SEQ ID NO: 281552
  misc_feature: GYAE6OF02IICCM.1.24.C02.1.454.CMB.1.raw
  modified_base (154)..(154): a, c, t, g, unknown or other
  misc_feature (154)..(154): n is a, c, g, or t

SEQ ID NO: 282540 - DNA, 155 bp, Homo sapiens; identical to SEQ ID NO: 282170
  misc_feature: GYAE6OF02HCXJ5.1.24.C02.1.454.CMB.1.raw
  modified_base (154)..(155): a, c, t, g, unknown or other
  misc_feature (154)..(155): n is a, c, g, or t

SEQ ID NO: 282541 - DNA, 155 bp, Homo sapiens; identical to SEQ ID NO: 281753
  misc_feature: GYAE6OF02GAAVU.1.24.C02.1.454.CMB.1.raw
  modified_base (154)..(155): a, c, t, g, unknown or other
  misc_feature (154)..(155): n is a, c, g, or t

SEQ ID NO: 282542 - DNA, 154 bp, Homo sapiens; identical to SEQ ID NO: 281604
  misc_feature: GYAE6OF02IEQ7V.1.24.C02.1.454.CMB.1.raw
  modified_base (154)..(154): a, c, t, g, unknown or other
  misc_feature (154)..(154): n is a, c, g, or t

SEQ ID NO: 282543 - DNA, 154 bp, Homo sapiens; identical to SEQ ID NO: 281552
  misc_feature: GYAE6OF02IG1ZR.1.24.C02.1.454.CMB.1.raw
  modified_base (154)..(154): a, c, t, g, unknown or other
  misc_feature (154)..(154): n is a, c, g, or t

SEQ ID NO: 282544 - DNA, 156 bp, Homo sapiens; identical to SEQ ID NO: 281762
  misc_feature: GYAE6OF02GX6JN.1.24.C02.1.454.CMB.1.raw
  modified_base (154)..(156): a, c, t, g, unknown or other
  misc_feature (154)..(156): n is a, c, g, or t

SEQ ID NO: 282545 - DNA, 155 bp, Homo sapiens
  misc_feature: GYAE6OF02GGAEB.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaatggaccaaggtggagatcaaacgaactgtggctgcaccatctgtcttcatcttcccaccctcctcatagcgtactctgagcgggctggcaaggcgcatagnn

SEQ ID NO: 282546 - DNA, 153 bp, Homo sapiens; identical to SEQ ID NO: 281651
  misc_feature: GYAE6OF02GB6UD.1.24.C02.1.454.CMB.1.raw
  modified_base (153)..(153): a, c, t, g, unknown or other
  misc_feature (153)..(153): n is a, c, g, or t

SEQ ID NO: 282547 - DNA, 154 bp, Homo sapiens; identical to SEQ ID NO: 281604
  misc_feature: GYAE6OF02GAM3C.1.24.C02.1.454.CMB.1.raw
  modified_base (154)..(154): a, c, t, g, unknown or other
  misc_feature (154)..(154): n is a, c, g, or t

SEQ ID NO: 282548 - DNA, 154 bp, Homo sapiens; identical to SEQ ID NO: 281552
  misc_feature: GYAE6OF02HOYE5.1.24.C02.1.454.CMB.1.raw
  modified_base (154)..(154): a, c, t, g, unknown or other
  misc_feature (154)..(154): n is a, c, g, or t

SEQ ID NO: 282549 - DNA, 158 bp, Homo sapiens
  misc_feature: GYAE6OF02HEOM7.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccaccctcctcacgtagcgtgctgagcgggctggcaaggcgcatagnnnnn

SEQ ID NO: 282550 - DNA, 155 bp, Homo sapiens; identical to SEQ ID NO: 282262
  misc_feature: GYAE6OF02FOGCQ.1.24.C02.1.454.CMB.1.raw
  modified_base (154)..(155): a, c, t, g, unknown or other
  misc_feature (154)..(155): n is a, c, g, or t

SEQ ID NO: 282551 - DNA, 154 bp, Homo sapiens; identical to SEQ ID NO: 281604
  misc_feature: GYAE6OF02GRHSD.1.24.C02.1.454.CMB.1.raw
  modified_base (154)..(154): a, c, t, g, unknown or other
  misc_feature (154)..(154): n is a, c, g, or t

SEQ ID NO: 282552 - DNA, 154 bp, Homo sapiens; identical to SEQ ID NO: 281998
  misc_feature: GYAE6OF02FQD7O.1.24.C02.1.454.CMB.1.raw
  modified_base (154)..(154): a, c, t, g, unknown or other
  misc_feature (154)..(154): n is a, c, g, or t

SEQ ID NO: 282553 - DNA, 164 bp, Homo sapiens
  misc_feature: GYAE6OF02FXBY7.1.24.C02.1.454.CMB.1.raw
  modified_base (153)..(164): a, c, t, g, unknown or other
  misc_feature (153)..(164): n is a, c, g, or t
tcagacgagtgcgtcacgaccggtgctcgatttagtacagatcgttagggaaggtgaccaaggtggagatcaaactaactgtggctgcaccatctgtcttcatcttccgccatctgatcgtactgcgctgagcgggctggcaaggcgcatagnnnnnnnnnnnn

SEQ ID NO: 282554 - DNA, 154 bp, Homo sapiens; identical to SEQ ID NO: 281604
  misc_feature: GYAE6OF02H9FDJ.1.24.C02.1.454.CMB.1.raw
  modified_base (154)..(154): a, c, t, g, unknown or other
  misc_feature (154)..(154): n is a, c, g, or t

SEQ ID NO: 282555 - DNA, 188 bp, Homo sapiens
  misc_feature: GYAE6OF02IIVEK.1.24.C02.1.454.CMB.1.raw
  modified_base (158)..(188): a, c, t, g, unknown or other
  misc_feature (158)..(188): n is a, c, g, or t
tcagacgagtgcgtcacgaccggtgctcgatttagtacagatcgttagggaaaggggaccaaggtggagactcaaacgaactgtcggctgcaccatctgtcttcatcttcccgccatctgaatagcgtactctgagcgggctaggcaaggcgcatagnnnnnnnnnnnnnnnnnnnnnnnnnnnnnnn

SEQ ID NO: 282556 - DNA, 155 bp, Homo sapiens
  misc_feature: GYAE6OF02IUKHD.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgtcatctgaacgcattcgtctgagcgggctggcaaggcgcatagnn

SEQ ID NO: 282557 - DNA, 155 bp, Homo sapiens; identical to SEQ ID NO: 281693
  misc_feature: GYAE6OF02FQ4FM.1.24.C02.1.454.CMB.1.raw
  modified_base (154)..(155): a, c, t, g, unknown or other
  misc_feature (154)..(155): n is a, c, g, or t

SEQ ID NO: 282558 - DNA, 153 bp, Homo sapiens
  misc_feature: GYAE6OF02H3D5M.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttaggcaagggaccaaggtggagatcaaacgaactgtggctgcaccatctgtcttcatcttcccgccatctgaatagcgtactctgagcgggctggcaaggcgcatagn

SEQ ID NO: 282559 - DNA, 155 bp, Homo sapiens; identical to SEQ ID NO: 281799
  misc_feature: GYAE6OF02IILWL.1.24.C02.1.454.CMB.1.raw
  modified_base (154)..(155): a, c, t, g, unknown or other
  misc_feature (154)..(155): n is a, c, g, or t

SEQ ID NO: 282560 - DNA, 154 bp, Homo sapiens; identical to SEQ ID NO: 281552
  misc_feature: GYAE6OF02HS7GP.1.24.C02.1.454.CMB.1.raw
  modified_base (154)..(154): a, c, t, g, unknown or other
  misc_feature (154)..(154): n is a, c, g, or t

SEQ ID NO: 282561 - DNA, 165 bp, Homo sapiens; identical to SEQ ID NO: 282200
  misc_feature: GYAE6OF02HD2DC.1.24.C02.1.454.CMB.1.raw
  modified_base (154)..(165): a, c, t, g, unknown or other
  misc_feature (154)..(165): n is a, c, g, or t

SEQ ID NO: 282562 - DNA, 154 bp, Homo sapiens; identical to SEQ ID NO: 281734
  misc_feature: GYAE6OF02IXD1O.1.24.C02.1.454.CMB.1.raw
  modified_base (154)..(154): a, c, t, g, unknown or other
  misc_feature (154)..(154): n is a, c, g, or t

SEQ ID NO: 282563 - DNA, 196 bp, Homo sapiens
  misc_feature: GYAE6OF02IE4UG.1.24.C02.1.454.CMB.1.raw
  modified_base (155)..(196): a, c, t, g, unknown or other
  misc_feature (155)..(196): n is a, c, g, or t
tcagacgagtgcgtcacgaccggtgctcgatttagtacagatcgttagggaaaggtgaccaaggtggagatcaaactaactgtggctgcaccatctgtcttcatcttcccgccatctgatcgtactgcgctgagcgggctggcaaggcgcatagnnnnnnnnnnnnnnnnnnnnnnnnnnnnnnnnnnnnnnnnnn

SEQ ID NO: 282564 - DNA, 158 bp, Homo sapiens
  misc_feature: GYAE6OF02HNZAX.1.24.C02.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnn

SEQ ID NO: 282565 - DNA, 175 bp, Homo sapiens
  misc_feature: GYAE6OF02H1FEB.1.24.C02.1.454.CMB.1.raw
  modified_base (155)..(175): a, c, t, g, unknown or other
  misc_feature (155)..(175): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcaatagnnnnnnnnnnnnnnnnnnnnn

SEQ ID NO: 282566 - DNA, 172 bp, Homo sapiens
  misc_feature: GYAE6OF02GZ5TH.1.24.C02.1.454.CMB.1.raw
  modified_base (154)..(172): a, c, t, g, unknown or other
  misc_feature (154)..(172): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnnnnnnnnnnnnnnnnnn

SEQ ID NO: 282567 - DNA, 151 bp, Homo sapiens
  misc_feature: GYAE6OF02JHQDT.1.24.C02.1.454.CMB.1.raw
tcagacgagtgcgtcacgaccggtgctcgatttagtacagatcgttagggaagggaccaaggtggagatcaacgaactgtggctgcaccatctgtcttcatcttcccgccatctgaacgcactcgtctgagcgggctggcaaggcgcatag

SEQ ID NO: 282568 - DNA, 154 bp, Homo sapiens; identical to SEQ ID NO: 281569
  misc_feature: GYAE6OF02IVS79.1.24.C02.1.454.CMB.1.raw
  modified_base (154)..(154): a, c, t, g, unknown or other
  misc_feature (154)..(154): n is a, c, g, or t

SEQ ID NO: 282569 - DNA, 154 bp, Homo sapiens; identical to SEQ ID NO: 281552
  misc_feature: GYAE6OF02HCUTF.1.24.C02.1.454.CMB.1.raw
  modified_base (154)..(154): a, c, t, g, unknown or other
  misc_feature (154)..(154): n is a, c, g, or t

SEQ ID NO: 282570 - DNA, 155 bp, Homo sapiens; identical to SEQ ID NO: 281675
  misc_feature: GYAE6OF02ICRV8.1.24.C02.1.454.CMB.1.raw
  modified_base (154)..(155): a, c, t, g, unknown or other
  misc_feature (154)..(155): n is a, c, g, or t

SEQ ID NO: 282571 - DNA, 154 bp, Homo sapiens; identical to SEQ ID NO: 281607
  misc_feature: GYAE6OF02IMRM1.1.24.C02.1.454.CMB.1.raw
  modified_base (154)..(154): a, c, t, g, unknown or other
  misc_feature (154)..(154): n is a, c, g, or t

SEQ ID NO: 282572 - DNA, 155 bp, Homo sapiens
  misc_feature: GYAE6OF02JUFKZ.1.24.C02.1.454.CMB.1.raw
  modified_base (149)..(155): a, c, t, g, unknown or other
  misc_feature (149)..(155): n is a, c, g, or t
tcagacgagtgcgtcacgaccggtgctcgatttagtacagatcgttaggaaggaccaaggtggagatcaacgaactgtggctgcaccatctgtcttcatcttccgccatctgaatagcgtactctgagcgggctggcaaggcgcatagnnnnnnn

SEQ ID NO: 282573 - DNA, 158 bp, Homo sapiens
  misc_feature: GYAE6OF02IROSD.1.24.C02.1.454.CMB.1.raw
  modified_base (133)..(133): a, c, t, g, unknown or other
  misc_feature (133)..(133): n is a, c, g, or t
  modified_base (154)..(158): a, c, t, g, unknown or other
  misc_feature (154)..(158): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgancgggctggcaaggcgcatagnnnnn

SEQ ID NO: 282574 - DNA, 181 bp, Homo sapiens
  misc_feature: GYAE6OF02FPU8G.1.24.C02.1.454.CMB.1.raw
  modified_base (156)..(181): a, c, t, g, unknown or other
  misc_feature (156)..(181): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctgggcaaaggcgcatagnnnnnnnnnnnnnnnnnnnnnnnnnn

SEQ ID NO: 282575 - DNA, 153 bp, Homo sapiens
  misc_feature: GYAE6OF02IXQU5.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccaccctcctcacgcactcgtctgagcgggctggcaaggcgcatag

SEQ ID NO: 282576 - DNA, 154 bp, Homo sapiens; identical to SEQ ID NO: 281681
  misc_feature: GYAE6OF02G3M9R.1.24.C02.1.454.CMB.1.raw
  modified_base (154)..(154): a, c, t, g, unknown or other
  misc_feature (154)..(154): n is a, c, g, or t

SEQ ID NO: 282577 - DNA, 155 bp, Homo sapiens; identical to SEQ ID NO: 281555
  misc_feature: GYAE6OF02FQPIF.1.24.C02.1.454.CMB.1.raw
  modified_base (154)..(155): a, c, t, g, unknown or other
  misc_feature (154)..(155): n is a, c, g, or t

SEQ ID NO: 282578 - DNA, 155 bp, Homo sapiens; identical to SEQ ID NO: 281575
  misc_feature: GYAE6OF02F6H3I.1.24.C02.1.454.CMB.1.raw
  modified_base (154)..(155): a, c, t, g, unknown or other
  misc_feature (154)..(155): n is a, c, g, or t

SEQ ID NO: 282579 - DNA, 208 bp, Homo sapiens
  misc_feature: GYAE6OF02ISNAY.1.24.C02.1.454.CMB.1.raw
  modified_base (168)..(208): a, c, t, g, unknown or other
  misc_feature (168)..(208): n is a, c, g, or t
tcagacgagtgcgtcacgaccggtgctcgatttagtacagatcgttagggcgtaaggggaccaaggtgtagatcaaacgaactgtggcctgcgacccatctacgtcttcatcttcccgccattcctgaatagcgtactctgacgcgggacctgggcaaggcgcatagnnnnnnnnnnnnnnnnnnnnnnnnnnnnnnnnnnnnnnnnn

SEQ ID NO: 282580 - DNA, 154 bp, Homo sapiens; identical to SEQ ID NO: 281604
  misc_feature: GYAE6OF02H3IZN.1.24.C02.1.454.CMB.1.raw
  modified_base (154)..(154): a, c, t, g, unknown or other
  misc_feature (154)..(154): n is a, c, g, or t

SEQ ID NO: 282581 - DNA, 154 bp, Homo sapiens; identical to SEQ ID NO: 281998
  misc_feature: GYAE6OF02F4SKZ.1.24.C02.1.454.CMB.1.raw
  modified_base (154)..(154): a, c, t, g, unknown or other
  misc_feature (154)..(154): n is a, c, g, or t

SEQ ID NO: 282582 - DNA, 165 bp, Homo sapiens
  misc_feature: GYAE6OF02IMQCG.1.24.C02.1.454.CMB.1.raw
  modified_base (155)..(165): a, c, t, g, unknown or other
  misc_feature (155)..(165): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnnnnnnnnn

SEQ ID NO: 282583 - DNA, 164 bp, Homo sapiens; identical to SEQ ID NO: 281630
  misc_feature: GYAE6OF02IAHIA.1.24.C02.1.454.CMB.1.raw
  modified_base (154)..(164): a, c, t, g, unknown or other
  misc_feature (154)..(164): n is a, c, g, or t

SEQ ID NO: 282584 - DNA, 155 bp, Homo sapiens; identical to SEQ ID NO: 281555
  misc_feature: GYAE6OF02I4U8C.1.24.C02.1.454.CMB.1.raw
  modified_base (154)..(155): a, c, t, g, unknown or other
  misc_feature (154)..(155): n is a, c, g, or t

SEQ ID NO: 282585 - DNA, 154 bp, Homo sapiens; identical to SEQ ID NO: 281552
  misc_feature: GYAE6OF02IUX29.1.24.C02.1.454.CMB.1.raw
  modified_base (154)..(154): a, c, t, g, unknown or other
  misc_feature (154)..(154): n is a, c, g, or t

SEQ ID NO: 282586 - DNA, 154 bp, Homo sapiens; identical to SEQ ID NO: 281572
  misc_feature: GYAE6OF02GKDAZ.1.24.C02.1.454.CMB.1.raw
  modified_base (154)..(154): a, c, t, g, unknown or other
  misc_feature (154)..(154): n is a, c, g, or t

SEQ ID NO: 282587 - DNA, 154 bp, Homo sapiens; identical to SEQ ID NO: 281604
  misc_feature: GYAE6OF02GGO2F.1.24.C02.1.454.CMB.1.raw
  modified_base (154)..(154): a, c, t, g, unknown or other
  misc_feature (154)..(154): n is a, c, g, or t

SEQ ID NO: 282588 - DNA, 153 bp, Homo sapiens; identical to SEQ ID NO: 281577
  misc_feature: GYAE6OF02HHT4R.1.24.C02.1.454.CMB.1.raw
  modified_base (153)..(153): a, c, t, g, unknown or other
  misc_feature (153)..(153): n is a, c, g, or t

SEQ ID NO: 282589 - DNA, 154 bp, Homo sapiens; identical to SEQ ID NO: 281609
  misc_feature: GYAE6OF02H4EK1.1.24.C02.1.454.CMB.1.raw
  modified_base (154)..(154): a, c, t, g, unknown or other
  misc_feature (154)..(154): n is a, c, g, or t

SEQ ID NO: 282590 - DNA, 162 bp, Homo sapiens; identical to SEQ ID NO: 281628
  misc_feature: GYAE6OF02IU3T1.1.24.C02.1.454.CMB.1.raw
  modified_base (154)..(162): a, c, t, g, unknown or other
  misc_feature (154)..(162): n is a, c, g, or t

SEQ ID NO: 282591 - DNA, 155 bp, Homo sapiens; identical to SEQ ID NO: 281555
  misc_feature: GYAE6OF02GXKBU.1.24.C02.1.454.CMB.1.raw
  modified_base (154)..(155): a, c, t, g, unknown or other
  misc_feature (154)..(155): n is a, c, g, or t

SEQ ID NO: 282592 - DNA, 154 bp, Homo sapiens; identical to SEQ ID NO: 281607
  misc_feature: GYAE6OF02I1VCZ.1.24.C02.1.454.CMB.1.raw
  modified_base (154)..(154): a, c, t, g, unknown or other
  misc_feature (154)..(154): n is a, c, g, or t

SEQ ID NO: 282593 - DNA, 212 bp, Homo sapiens
  misc_feature: GYAE6OF02ID5U5.1.24.C02.1.454.CMB.1.raw
  modified_base (204)..(212): a, c, t, g, unknown or other
  misc_feature (204)..(212): n is a, c, g, or t
tcagacgagtgcgtcacgaccggtgctcgatttagtacagatcgttagggaaagggaccaaggtggagatcaaacgaactgtggctgcaccactgtcttctactacttcccgtcccgactacttcgtaacggaaccgacctaccgttccgttcgtaggacggggccgggttcggtcggaaacggaacgggccgaactaagtagnnnnnnnnn

SEQ ID NO: 282594 - DNA, 158 bp, Homo sapiens
  misc_feature: GYAE6OF02JG9LT.1.24.C02.1.454.CMB.1.raw
  modified_base (151)..(158): a, c, t, g, unknown or other
  misc_feature (151)..(158): n is a, c, g, or t
tcagacgagtgcgtcacgaccggtgctcgatttagtacagatcgttaggcaagggaccaaggtggagatcaaacgaactgtggctgcaccatctgtcttcatcttccgccatctgaatagcgtactctgagcggctggcaaggcgcatagnnnnnnnn

SEQ ID NO: 282595 - DNA, 157 bp, Homo sapiens
  misc_feature: GYAE6OF02F1RPV.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnnn

SEQ ID NO: 282596 - DNA, 161 bp, Homo sapiens; identical to SEQ ID NO: 281600
  misc_feature: GYAE6OF02GNTOO.1.24.C02.1.454.CMB.1.raw
  modified_base (154)..(161): a, c, t, g, unknown or other
  misc_feature (154)..(161): n is a, c, g, or t

SEQ ID NO: 282597 - DNA, 156 bp, Homo sapiens; identical to SEQ ID NO: 281661
  misc_feature: GYAE6OF02HVIXR.1.24.C02.1.454.CMB.1.raw
  modified_base (154)..(156): a, c, t, g, unknown or other
  misc_feature (154)..(156): n is a, c, g, or t

SEQ ID NO: 282598 - DNA, 155 bp, Homo sapiens; identical to SEQ ID NO: 281555
  misc_feature: GYAE6OF02F433A.1.24.C02.1.454.CMB.1.raw
  modified_base (154)..(155): a, c, t, g, unknown or other
  misc_feature (154)..(155): n is a, c, g, or t

SEQ ID NO: 282599 - DNA, 155 bp, Homo sapiens; identical to SEQ ID NO: 281697
  misc_feature: GYAE6OF02G61RU.1.24.C02.1.454.CMB.1.raw
  modified_base (154)..(155): a, c, t, g, unknown or other
  misc_feature (154)..(155): n is a, c, g, or t

SEQ ID NO: 282600 - DNA, 154 bp, Homo sapiens; identical to SEQ ID NO: 281641
  misc_feature: GYAE6OF02GJ8QQ.1.24.C02.1.454.CMB.1.raw
  modified_base (154)..(154): a, c, t, g, unknown or other
  misc_feature (154)..(154): n is a, c, g, or t

SEQ ID NO: 282601 - DNA, 155 bp, Homo sapiens; identical to SEQ ID NO: 281555
  misc_feature: GYAE6OF02IHHDM.1.24.C02.1.454.CMB.1.raw
  modified_base (154)..(155): a, c, t, g, unknown or other
  misc_feature (154)..(155): n is a, c, g, or t

SEQ ID NO: 282602 - DNA, 153 bp, Homo sapiens; identical to SEQ ID NO: 282473
  misc_feature: GYAE6OF02GUFO9.1.24.C02.1.454.CMB.1.raw
  modified_base (153)..(153): a, c, t, g, unknown or other
  misc_feature (153)..(153): n is a, c, g, or t

SEQ ID NO: 282603 - DNA, 155 bp, Homo sapiens; identical to SEQ ID NO: 281575
  misc_feature: GYAE6OF02HCTJJ.1.24.C02.1.454.CMB.1.raw
  modified_base (154)..(155): a, c, t, g, unknown or other
  misc_feature (154)..(155): n is a, c, g, or t

SEQ ID NO: 282604 - DNA, 156 bp, Homo sapiens; identical to SEQ ID NO: 282176
  misc_feature: GYAE6OF02JC7FT.1.24.C02.1.454.CMB.1.raw
  modified_base (154)..(156): a, c, t, g, unknown or other
  misc_feature (154)..(156): n is a, c, g, or t

SEQ ID NO: 282605 - DNA, 164 bp, Homo sapiens; identical to SEQ ID NO: 281630
  misc_feature: GYAE6OF02G8OPC.1.24.C02.1.454.CMB.1.raw
  modified_base (154)..(164): a, c, t, g, unknown or other
  misc_feature (154)..(164): n is a, c, g, or t

SEQ ID NO: 282606 - DNA, 153 bp, Homo sapiens; identical to SEQ ID NO: 282473
  misc_feature: GYAE6OF02F7447.1.24.C02.1.454.CMB.1.raw
  modified_base (153)..(153): a, c, t, g, unknown or other
  misc_feature (153)..(153): n is a, c, g, or t

SEQ ID NO: 282607 - DNA, 156 bp, Homo sapiens; identical to SEQ ID NO: 281661
  misc_feature: GYAE6OF02HFP1U.1.24.C02.1.454.CMB.1.raw
  modified_base (154)..(156): a, c, t, g, unknown or other
  misc_feature (154)..(156): n is a, c, g, or t

SEQ ID NO: 282608 - DNA, 154 bp, Homo sapiens; identical to SEQ ID NO: 281607
  misc_feature: GYAE6OF02JJ0B6.1.24.C02.1.454.CMB.1.raw
  modified_base (154)..(154): a, c, t, g, unknown or other
  misc_feature (154)..(154): n is a, c, g, or t

SEQ ID NO: 282609 - DNA, 155 bp, Homo sapiens; identical to SEQ ID NO: 281575
  misc_feature: GYAE6OF02HHEAM.1.24.C02.1.454.CMB.1.raw
  modified_base (154)..(155): a, c, t, g, unknown or other
  misc_feature (154)..(155): n is a, c, g, or t

SEQ ID NO: 282610 - DNA, 171 bp, Homo sapiens
  misc_feature: GYAE6OF02IGY1Y.1.24.C02.1.454.CMB.1.raw
  modified_base (154)..(171): a, c, t, g, unknown or other
  misc_feature (154)..(171): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnnnnnnnnn

SEQ ID NO: 282611 - DNA, 153 bp, Homo sapiens
  misc_feature: GYAE6OF02G6H4Q.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaagggaccaaggtggagatcaaacgaactgttgctgcaccatctgtcttcatcttcccgccatctgatcgtagcactctgagcgggctggcaaggcgcatagn

SEQ ID NO: 282612 - DNA, 155 bp, Homo sapiens; identical to SEQ ID NO: 281753
  misc_feature: GYAE6OF02I286A.1.24.C02.1.454.CMB.1.raw
  modified_base (154)..(155): a, c, t, g, unknown or other
  misc_feature (154)..(155): n is a, c, g, or t

SEQ ID NO: 282613 - DNA, 154 bp, Homo sapiens; identical to SEQ ID NO: 281641
  misc_feature: GYAE6OF02HD9RV.1.24.C02.1.454.CMB.1.raw
  modified_base (154)..(154): a, c, t, g, unknown or other
  misc_feature (154)..(154): n is a, c, g, or t

SEQ ID NO: 282614 - DNA, 173 bp, Homo sapiens
  misc_feature: GYAE6OF02H6Y0R.1.24.C02.1.454.CMB.1.raw
  modified_base (153)..(173): a, c, t, g, unknown or other
  misc_feature (153)..(173): n is a, c, g, or t
tcagacgagtgcgtcacgaccggtgctcgatttagtacagatcgttagggaaaggaccaaggtggagatcaaacgaactgtggctgcaccatctgtcttcatcttcccgccatctgaacgcactcgtctgagcgggctggcaaggcgcatagnnnnnnnnnnnnnnnnnnnnn

SEQ ID NO: 282615 - DNA, 155 bp, Homo sapiens; identical to SEQ ID NO: 281675
  misc_feature: GYAE6OF02HW0E8.1.24.C02.1.454.CMB.1.raw
  modified_base (154)..(155): a, c, t, g, unknown or other
  misc_feature (154)..(155): n is a, c, g, or t

SEQ ID NO: 282616 - DNA, 154 bp, Homo sapiens; identical to SEQ ID NO: 281641
  misc_feature: GYAE6OF02GAZ8Y.1.24.C02.1.454.CMB.1.raw
  modified_base (154)..(154): a, c, t, g, unknown or other
  misc_feature (154)..(154): n is a, c, g, or t

SEQ ID NO: 282617 - DNA, 158 bp, Homo sapiens
  misc_feature: GYAE6OF02FQ48F.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnnnn

SEQ ID NO: 282618 - DNA, 154 bp, Homo sapiens; identical to SEQ ID NO: 281552
  misc_feature: GYAE6OF02ISGKI.1.24.C02.1.454.CMB.1.raw
  modified_base (154)..(154): a, c, t, g, unknown or other
  misc_feature (154)..(154): n is a, c, g, or t

SEQ ID NO: 282619 - DNA, 154 bp, Homo sapiens; identical to SEQ ID NO: 281552
  misc_feature: GYAE6OF02IJEP3.1.24.C02.1.454.CMB.1.raw
  modified_base (154)..(154): a, c, t, g, unknown or other
  misc_feature (154)..(154): n is a, c, g, or t

SEQ ID NO: 282620 - DNA, 154 bp, Homo sapiens; identical to SEQ ID NO: 281552
  misc_feature: GYAE6OF02ILPNU.1.24.C02.1.454.CMB.1.raw
  modified_base (154)..(154): a, c, t, g, unknown or other
  misc_feature (154)..(154): n is a, c, g, or t

SEQ ID NO: 282621 - DNA, 189 bp, Homo sapiens
  misc_feature: GYAE6OF02IGURW.1.24.C02.1.454.CMB.1.raw
  modified_base (158)..(189): a, c, t, g, unknown or other
  misc_feature (158)..(189): n is a, c, g, or t
tcagacgagtgcgtcacgaccggtgctcgatttagtacagatcgttagggaaagggtaccgaaggtggagatcaaacgaacgtgtggctgcaccatctgtcttcatcttcccgcctatctgatatgttactctgagcgggctggcaaggcgcgatagnnnnnnnnnnnnnnnnnnnnnnnnnnnnnnnn

SEQ ID NO: 282622 - DNA, 164 bp, Homo sapiens
  misc_feature: GYAE6OF02GR669.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnnnnnnnn

SEQ ID NO: 282623 - DNA, 154 bp, Homo sapiens; identical to SEQ ID NO: 281609
  misc_feature: GYAE6OF02HNVJ9.1.24.C02.1.454.CMB.1.raw
  modified_base (154)..(154): a, c, t, g, unknown or other
  misc_feature (154)..(154): n is a, c, g, or t

SEQ ID NO: 282624 - DNA, 154 bp, Homo sapiens; identical to SEQ ID NO: 281641
  misc_feature: GYAE6OF02GVLH9.1.24.C02.1.454.CMB.1.raw
  modified_base (154)..(154): a, c, t, g, unknown or other
  misc_feature (154)..(154): n is a, c, g, or t

SEQ ID NO: 282625 - DNA, 156 bp, Homo sapiens
  misc_feature: GYAE6OF02JHL8J.1.24.C02.1.454.CMB.1.raw
  modified_base (152)..(156): a, c, t, g, unknown or other
  misc_feature (152)..(156): n is a, c, g, or t
tcagacgagtgcgtcacgaccggtgctcgatttagtacagatcgttaggaaagggaccaaggtggagatcaaactaactgtggctgcacaatctgtcttcatcttccgccatctgatcgtactgcgctgagcgggctggcaaggcgcatagnnnnn

SEQ ID NO: 282626 - DNA, 154 bp, Homo sapiens; identical to SEQ ID NO: 281569
  misc_feature: GYAE6OF02FNH6Z.1.24.C02.1.454.CMB.1.raw
  modified_base (154)..(154): a, c, t, g, unknown or other
  misc_feature (154)..(154): n is a, c, g, or t

SEQ ID NO: 282627 - DNA, 155 bp, Homo sapiens; identical to SEQ ID NO: 281575
  misc_feature: GYAE6OF02F6U3J.1.24.C02.1.454.CMB.1.raw
  modified_base (154)..(155): a, c, t, g, unknown or other
  misc_feature (154)..(155): n is a, c, g, or t

SEQ ID NO: 282628 - DNA, 154 bp, Homo sapiens; identical to SEQ ID NO: 281604
  misc_feature: GYAE6OF02I8CVQ.1.24.C02.1.454.CMB.1.raw
  modified_base (154)..(154): a, c, t, g, unknown or other
  misc_feature (154)..(154): n is a, c, g, or t

SEQ ID NO: 282629 - DNA, 154 bp, Homo sapiens; identical to SEQ ID NO: 281604
  misc_feature: GYAE6OF02IR0SM.1.24.C02.1.454.CMB.1.raw
  modified_base (154)..(154): a, c, t, g, unknown or other
  misc_feature (154)..(154): n is a, c, g, or t

SEQ ID NO: 282630 - DNA, 157 bp, Homo sapiens
  misc_feature: GYAE6OF02JUFUX.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnnn

SEQ ID NO: 282631 - DNA, 154 bp, Homo sapiens; identical to SEQ ID NO: 281552
  misc_feature: GYAE6OF02HZNGM.1.24.C02.1.454.CMB.1.raw
  modified_base (154)..(154): a, c, t, g, unknown or other
  misc_feature (154)..(154): n is a, c, g, or t

SEQ ID NO: 282632 - DNA, 155 bp, Homo sapiens; identical to SEQ ID NO: 281978
  misc_feature: GYAE6OF02INIJJ.1.24.C02.1.454.CMB.1.raw
  modified_base (154)..(155): a, c, t, g, unknown or other
  misc_feature (154)..(155): n is a, c, g, or t

SEQ ID NO: 282633 - DNA, 154 bp, Homo sapiens; identical to SEQ ID NO: 281604
  misc_feature: GYAE6OF02F5D1G.1.24.C02.1.454.CMB.1.raw
  modified_base (154)..(154): a, c, t, g, unknown or other
  misc_feature (154)..(154): n is a, c, g, or t

SEQ ID NO: 282634 - DNA, 174 bp, Homo sapiens
  misc_feature: GYAE6OF02GSBQB.1.24.C02.1.454.CMB.1.raw
  modified_base (157)..(174): a, c, t, g, unknown or other
  misc_feature (157)..(174): n is a, c, g, or t
tcagacgagtgcgtcacgaccggtgctcgatttagtacagatcgttagggaagtggaccaagggtggagatcaaacgaactgtggctgcaccatctgtccttcatcttcccaccctccgtctctctcgactctgagcgggctggcaaggcgcatagnnnnnnnnnnnnnnnnnn

SEQ ID NO: 282635 - DNA, 155 bp, Homo sapiens; identical to SEQ ID NO: 281753
  misc_feature: GYAE6OF02F0CMS.1.24.C02.1.454.CMB.1.raw
  modified_base (154)..(155): a, c, t, g, unknown or other
  misc_feature (154)..(155): n is a, c, g, or t

SEQ ID NO: 282636 - DNA, 155 bp, Homo sapiens; identical to SEQ ID NO: 281799
  misc_feature: GYAE6OF02G2I20.1.24.C02.1.454.CMB.1.raw
  modified_base (154)..(155): a, c, t, g, unknown or other
  misc_feature (154)..(155): n is a, c, g, or t

SEQ ID NO: 282637 - DNA, 154 bp, Homo sapiens; identical to SEQ ID NO: 281607
  misc_feature: GYAE6OF02G5KH5.1.24.C02.1.454.CMB.1.raw
  modified_base (154)..(154): a, c, t, g, unknown or other
  misc_feature (154)..(154): n is a, c, g, or t

SEQ ID NO: 282638 - DNA, 155 bp, Homo sapiens; identical to SEQ ID NO: 281697
  misc_feature: GYAE6OF02HDBAL.1.24.C02.1.454.CMB.1.raw
  modified_base (154)..(155): a, c, t, g, unknown or other
  misc_feature (154)..(155): n is a, c, g, or t

SEQ ID NO: 282639 - DNA, 156 bp, Homo sapiens; identical to SEQ ID NO: 281772
  misc_feature: GYAE6OF02GV4N4.1.24.C02.1.454.CMB.1.raw
  modified_base (154)..(156): a, c, t, g, unknown or other
  misc_feature (154)..(156): n is a, c, g, or t

SEQ ID NO: 282640 - DNA, 166 bp, Homo sapiens; identical to SEQ ID NO: 281717
  misc_feature: GYAE6OF02GSKZN.1.24.C02.1.454.CMB.1.raw
  modified_base (154)..(166): a, c, t, g, unknown or other
  misc_feature (154)..(166): n is a, c, g, or t

SEQ ID NO: 282641 - DNA, 154 bp, Homo sapiens
  misc_feature: GYAE6OF02GMF7B.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcattttcccgccatctgaatagcgtactctgagcgggctggcaaggcgcatagn

SEQ ID NO: 282642 - DNA, 193 bp, Homo sapiens
  misc_feature: GYAE6OF02HGJ86.1.24.C02.1.454.CMB.1.raw
  modified_base (158)..(193): a, c, t, g, unknown or other
  misc_feature (158)..(193): n is a, c, g, or t
tcagacgagtgcgtcacgaccggtgctcgatttagtacagatcgttagggcaagggaccaaggtgggagatcaaacgaactgtggctgccaccatctgtcttcatcttcccgccatctgaatagccgtactctgagcggggctggcaaggcgcatagnnnnnnnnnnnnnnnnnnnnnnnnnnnnnnnnnnnn

SEQ ID NO: 282643 - DNA, 155 bp, Homo sapiens; identical to SEQ ID NO: 281555
  misc_feature: GYAE6OF02F7J1I.1.24.C02.1.454.CMB.1.raw
  modified_base (154)..(155): a, c, t, g, unknown or other
  misc_feature (154)..(155): n is a, c, g, or t

SEQ ID NO: 282644 - DNA, 156 bp, Homo sapiens; identical to SEQ ID NO: 282176
  misc_feature: GYAE6OF02F7TIC.1.24.C02.1.454.CMB.1.raw
  modified_base (154)..(156): a, c, t, g, unknown or other
  misc_feature (154)..(156): n is a, c, g, or t

SEQ ID NO: 282645 - DNA, 154 bp, Homo sapiens; identical to SEQ ID NO: 281609
  misc_feature: GYAE6OF02GEWC4.1.24.C02.1.454.CMB.1.raw
  modified_base (154)..(154): a, c, t, g, unknown or other
  misc_feature (154)..(154): n is a, c, g, or t

SEQ ID NO: 282646 - DNA, 207 bp, Homo sapiens
  misc_feature: GYAE6OF02HB474.1.24.C02.1.454.CMB.1.raw
  modified_base (166)..(207): a, c, t, g, unknown or other
  misc_feature (166)..(207): n is a, c, g, or t
tcagacgagtgcgtcacgaccggtgctcgatttagtacagatcgttagggaaagggtaccgaaggtggagatcaaacgaacttgtggctgcaccagttcgtgtcttcactcttccccgccatcctgaacgcactcggtctgagcgggcctggcaaggcgcataggnnnnnnnnnnnnnnnnnnnnnnnnnnnnnnnnnnnnnnnnnn

SEQ ID NO: 282647 - DNA, 154 bp, Homo sapiens; identical to SEQ ID NO: 281998
  misc_feature: GYAE6OF02F612E.1.24.C02.1.454.CMB.1.raw
  modified_base (154)..(154): a, c, t, g, unknown or other
  misc_feature (154)..(154): n is a, c, g, or t

SEQ ID NO: 282648 - DNA, 157 bp, Homo sapiens
  misc_feature: GYAE6OF02JPCH8.1.24.C02.1.454.CMB.1.raw
  modified_base (151)..(157): a, c, t, g, unknown or other
  misc_feature (151)..(157): n is a, c, g, or t
tcagacgagtgcgtcacgaccggtgctcgatttagtacagatcgttaggcaagggaccaaggtggagatcaaacgaactgtggctgcaccatctgtcttcatcttccgccatctgaatagcgtactctgagcggctggcaaggcgcatagnnnnnnn

SEQ ID NO: 282649 - DNA, 155 bp, Homo sapiens; identical to SEQ ID NO: 281555
  misc_feature: GYAE6OF02HEFUU.1.24.C02.1.454.CMB.1.raw
  modified_base (154)..(155): a, c, t, g, unknown or other
  misc_feature (154)..(155): n is a, c, g, or t

SEQ ID NO: 282650 - DNA, 155 bp, Homo sapiens
  misc_feature: GYAE6OF02JCIWO.1.24.C02.1.454.CMB.1.raw
  modified_base (152)..(155): a, c, t, g, unknown or other
  misc_feature (152)..(155): n is a, c, g, or t
tcagacgagtgcgtcacgaccggtgctcgatttagtacagatcgttaggcaagggaccaaggtggagatcaaacgaactgtggctgcaccatctgtcttcatcttcccgccatctgaatagcgtactctgagcggctggcaaggcgcatagnnnn

SEQ ID NO: 282651 - DNA, 155 bp, Homo sapiens; identical to SEQ ID NO: 281555
  misc_feature: GYAE6OF02I9KQU.1.24.C02.1.454.CMB.1.raw
  modified_base (154)..(155): a, c, t, g, unknown or other
  misc_feature (154)..(155): n is a, c, g, or t

SEQ ID NO: 282652 - DNA, 202 bp, Homo sapiens
  misc_feature: GYAE6OF02HCCP0.1.24.C02.1.454.CMB.1.raw
  modified_base (156)..(202): a, c, t, g, unknown or other
  misc_feature (156)..(202): n is a, c, g, or t
tcagacgagtgcgtcacgaccggtgctcgatttagtacagatcgttagggaaaggtgaccaaggtggagatcaaactaactgtggctgcaccatctcgtcttcatcttcccgccatctgatcgtactgcgctgagcgggctggcaaggcgcatagnnnnnnnnnnnnnnnnnnnnnnnnnnnnnnnnnnnnnnnnnnnnnnn

SEQ ID NO: 282653 - DNA, 154 bp, Homo sapiens
  misc_feature: GYAE6OF02IS9O0.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtgtagatcaaacgaactgtggctgcaccatctgtcttcatcttcacgccatctgaatagcgtactctgagcgggctggcaaggcgcatagn

SEQ ID NO: 282654 - DNA, 197 bp, Homo sapiens
  misc_feature: GYAE6OF02GG9H1.1.24.C02.1.454.CMB.1.raw
  modified_base (157)..(197): a, c, t, g, unknown or other
  misc_feature (157)..(197): n is a, c, g, or t
tcagacgagtgcgtcacgaccggtgctcgatttagtacagatcgttagggaaaggggaccaaggtggagatcaaacgaactgtggctgcaccatctgtcttcatcttcccgccatctgaatagcgtactctggagcgggctggcaagggcgcatagnnnnnnnnnnnnnnnnnnnnnnnnnnnnnnnnnnnnnnnnn

SEQ ID NO: 282655 - DNA, 155 bp, Homo sapiens; identical to SEQ ID NO: 281575
  misc_feature: GYAE6OF02G07RE.1.24.C02.1.454.CMB.1.raw
  modified_base (154)..(155): a, c, t, g, unknown or other
  misc_feature (154)..(155): n is a, c, g, or t

SEQ ID NO: 282656 - DNA, 155 bp, Homo sapiens; identical to SEQ ID NO: 281931
  misc_feature: GYAE6OF02GTVTD.1.24.C02.1.454.CMB.1.raw
  modified_base (154)..(155): a, c, t, g, unknown or other
  misc_feature (154)..(155): n is a, c, g, or t

SEQ ID NO: 282657 - DNA, 154 bp, Homo sapiens; identical to SEQ ID NO: 281572
  misc_feature: GYAE6OF02H4CBI.1.24.C02.1.454.CMB.1.raw
  modified_base (154)..(154): a, c, t, g, unknown or other
  misc_feature (154)..(154): n is a, c, g, or t

SEQ ID NO: 282658 - DNA, 154 bp, Homo sapiens; identical to SEQ ID NO: 281607
  misc_feature: GYAE6OF02GTYMJ.1.24.C02.1.454.CMB.1.raw
  modified_base (154)..(154): a, c, t, g, unknown or other
  misc_feature (154)..(154): n is a, c, g, or t

SEQ ID NO: 282659 - DNA, 155 bp, Homo sapiens; identical to SEQ ID NO: 281693
  misc_feature: GYAE6OF02GXU11.1.24.C02.1.454.CMB.1.raw
  modified_base (154)..(155): a, c, t, g, unknown or other
  misc_feature (154)..(155): n is a, c, g, or t

SEQ ID NO: 282660 - DNA, 154 bp, Homo sapiens; identical to SEQ ID NO: 281609
  misc_feature: GYAE6OF02I0TBW.1.24.C02.1.454.CMB.1.raw
  modified_base (154)..(154): a, c, t, g, unknown or other
  misc_feature (154)..(154): n is a, c, g, or t

SEQ ID NO: 282661 - DNA, 155 bp, Homo sapiens; identical to SEQ ID NO: 281555
  misc_feature: GYAE6OF02F8EY8.1.24.C02.1.454.CMB.1.raw
  modified_base (154)..(155): a, c, t, g, unknown or other
  misc_feature (154)..(155): n is a, c, g, or t

SEQ ID NO: 282662 - DNA, 158 bp, Homo sapiens; identical to SEQ ID NO: 282361
  misc_feature: GYAE6OF02HSJ5Y.1.24.C02.1.454.CMB.1.raw
  modified_base (154)..(158): a, c, t, g, unknown or other
  misc_feature (154)..(158): n is a, c, g, or t

SEQ ID NO: 282663 - DNA, 155 bp, Homo sapiens; identical to SEQ ID NO: 281555
  misc_feature: GYAE6OF02H5OQ9.1.24.C02.1.454.CMB.1.raw
  modified_base (154)..(155): a, c, t, g, unknown or other
  misc_feature (154)..(155): n is a, c, g, or t

SEQ ID NO: 282664 - DNA, 169 bp, Homo sapiens
  misc_feature: GYAE6OF02IWX5S.1.24.C02.1.454.CMB.1.raw
  modified_base (158)..(169): a, c, t, g, unknown or other
  misc_feature (158)..(169): n is a, c, g, or t
tcagacgagtgcgtcacgaccggtgctcgatttagtacagatcgttagggaaagggtaccgaaggtggagatcaaacgaactgtggctgcaccatctgtcttcatcttcccgccactcctgaatagcgtactctgagcgggctggcaaggcgcatagnnnnnnnnnnnn

SEQ ID NO: 282665 - DNA, 154 bp, Homo sapiens; identical to SEQ ID NO: 281552
  misc_feature: GYAE6OF02IL2K4.1.24.C02.1.454.CMB.1.raw
  modified_base (154)..(154): a, c, t, g, unknown or other
  misc_feature (154)..(154): n is a, c, g, or t

SEQ ID NO: 282666 - DNA, 155 bp, Homo sapiens
  misc_feature: GYAE6OF02JDEJZ.1.24.C02.1.454.CMB.1.raw
  modified_base (130)..(130): a, c, t, g, unknown or other
  misc_feature (130)..(130): n is a, c, g, or t
  modified_base (151)..(155): a, c, t, g, unknown or other
  misc_feature (151)..(155): n is a, c, g, or t
tcagacgagtgcgtcacgaccggtgctcgatttagtacagatcgttaggaagtgaccaaggtggagatcaactaactgtggctgcaccatctgtcttcatcttcccgccatctgatcgtactgcgctgancgggctggcaaggcgcatagnnnnn

SEQ ID NO: 282667 - DNA, 166 bp, Homo sapiens
  misc_feature: GYAE6OF02IDUVY.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggaaagggaccaaggtggagatcaaacgaactgtggctgcaccatctgtcttcatcttcccacccgtcctcacgtagcgtgctgagcgggctggcaaggcgcatagnnnnnnnnnnnn

SEQ ID NO: 282668 - DNA, 154 bp, Homo sapiens
  misc_feature: GYAE6OF02HN9UR.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgtaccatctgtcttcatcttcccgccatctgaatagcgtactctgagcgggctggcaaggcgcatagn

SEQ ID NO: 282669 - DNA, 179 bp, Homo sapiens
  misc_feature: GYAE6OF02HZHYU.1.24.C02.1.454.CMB.1.raw
  modified_base (157)..(179): a, c, t, g, unknown or other
  misc_feature (157)..(179): n is a, c, g, or t
tcagacgagtgcgtcacgaccggtgctcgatttagtacagatcgttagggaaagggaccaagggtggagatcaaacgaactgtggctgcaccatcctgtcttcatcttcccgccatctgaacgcactcgtctgagcgggctggcaaggcgccatagnnnnnnnnnnnnnnnnnnnnnnn

SEQ ID NO: 282670 - DNA, 220 bp, Homo sapiens
  misc_feature: GYAE6OF02HTVUB.1.24.C02.1.454.CMB.1.raw
  modified_base (161)..(220): a, c, t, g, unknown or other
  misc_feature (161)..(220): n is a, c, g, or t
tcagacgagtgcgtcacgaccggtgctcgatttagtacagatcgttagggtcgaagggacccaaggtggagatcaaacggaactgtggctgaaccatctgtcttcatcttcccgccatctgaatagcgtactctgagcggggctcggcaaggcgcataggnnnnnnnnnnnnnnnnnnnnnnnnnnnnnnnnnnnnnnnnnnnnnnnnnnnnnnnnnnnn

SEQ ID NO: 282671 - DNA, 154 bp, Homo sapiens
  misc_feature: GYAE6OF02GH6IB.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgactctgagcgggctggcaaggcgcatagnn

SEQ ID NO: 282672 - DNA, 155 bp, Homo sapiens; identical to SEQ ID NO: 281575
  misc_feature: GYAE6OF02H435K.1.24.C02.1.454.CMB.1.raw
  modified_base (154)..(155): a, c, t, g, unknown or other
  misc_feature (154)..(155): n is a, c, g, or t

SEQ ID NO: 282673 - DNA, 155 bp, Homo sapiens; identical to SEQ ID NO: 281555
  misc_feature: GYAE6OF02H3ZFQ.1.24.C02.1.454.CMB.1.raw
  modified_base (154)..(155): a, c, t, g, unknown or other
  misc_feature (154)..(155): n is a, c, g, or t

SEQ ID NO: 282674 - DNA, 155 bp, Homo sapiens
  misc_feature: GYAE6OF02I9OZ6.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggaaagggaccaaggtggagatcaaacgaactgttgctgcaccatctgtcttcatcttccgccatctgatcgtagcactctgagcgggctggcaaggcgcatagnnn

SEQ ID NO: 282675 - DNA, 162 bp, Homo sapiens
  misc_feature: GYAE6OF02GNAX5.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggaaaggaccaaggtggagatcaaacgaactgtggctgcaccatctgtcttcatcttcccgccatctggaatagcgtactctgagcgggctggcaaggcgcatagnnnnnnnnn

SEQ ID NO: 282676 - DNA, 154 bp, Homo sapiens; identical to SEQ ID NO: 281607
  misc_feature: GYAE6OF02HEX1A.1.24.C02.1.454.CMB.1.raw
  modified_base (154)..(154): a, c, t, g, unknown or other
  misc_feature (154)..(154): n is a, c, g, or t

SEQ ID NO: 282677 - DNA, 155 bp, Homo sapiens; identical to SEQ ID NO: 281575
  misc_feature: GYAE6OF02HH0SH.1.24.C02.1.454.CMB.1.raw
  modified_base (154)..(155): a, c, t, g, unknown or other
  misc_feature (154)..(155): n is a, c, g, or t

SEQ ID NO: 282678 - DNA, 156 bp, Homo sapiens; identical to SEQ ID NO: 281659
  misc_feature: GYAE6OF02JPU9S.1.24.C02.1.454.CMB.1.raw
  modified_base (154)..(156): a, c, t, g, unknown or other
  misc_feature (154)..(156): n is a, c, g, or t

SEQ ID NO: 282679 - DNA, 154 bp, Homo sapiens; identical to SEQ ID NO: 281552
  misc_feature: GYAE6OF02GRRPX.1.24.C02.1.454.CMB.1.raw
  modified_base (154)..(154): a, c, t, g, unknown or other
  misc_feature (154)..(154): n is a, c, g, or t

SEQ ID NO: 282680 - DNA, 156 bp, Homo sapiens; identical to SEQ ID NO: 281741
  misc_feature: GYAE6OF02HULNH.1.24.C02.1.454.CMB.1.raw
  modified_base (154)..(156): a, c, t, g, unknown or other
  misc_feature (154)..(156): n is a, c, g, or t

SEQ ID NO: 282681 - DNA, 164 bp, Homo sapiens
  misc_feature: GYAE6OF02H4QUA.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggcaagggaccaaggtggagatcaaacgaactgtggctgcaccatctgtctttatcttcccgccatctgaatagcgtactctgagcgggctggcaaggcgcatagnnnnnnnnnnn

SEQ ID NO: 282682 - DNA, 154 bp, Homo sapiens; identical to SEQ ID NO: 281607
  misc_feature: GYAE6OF02HZ4WI.1.24.C02.1.454.CMB.1.raw
  modified_base (154)..(154): a, c, t, g, unknown or other
  misc_feature (154)..(154): n is a, c, g, or t

SEQ ID NO: 282683 - DNA, 680 bp, Homo sapiens
  misc_feature: GYAE6OF02IGTDS.1.24.C02.1.454.CMB.1.raw
  modified_base (144)..(144): a, c, t, g, unknown or other
  misc_feature (144)..(144): n is a, c, g, or t
  modified_base (181)..(181): a, c, t, g, unknown or other
  misc_feature (181)..(181): n is a, c, g, or t
  modified_base (205)..(206): a, c, t, g, unknown or other
  misc_feature (205)..(206): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (223)..(224): a, c, t, g, unknown or other
  misc_feature (223)..(224): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (235)..(236): a, c, t, g, unknown or other
  misc_feature (235)..(236): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
tcagacgagtgcgtccacgaccggtgctcgatttagtacagatcgttaggcggaagggaccaaggtggagattcgaaaccgaactggtacggctggacaccccatctgtcttctatcttcccgccatccttgatggcgtacctntgtacgccggggctaggtcaagggtcgccaataggcncagcactgtcttgctcagggaacnnccacctntcngcaggcnncngngtgtagnnctactcnctgtancacagacncgcacgctccncgctcctctactctatgntcgcactaccacgacggaccgacgtcgtctactccgacgtaccgtacggtacgtacgtacgtacgtacggtcggtcggtacggacgtacgtacgttacgtacctcctacctacctactacgtacgtacgtaccgtacgtacgtaccgtacgtaacgttacgtttacgtacgtacgttacgttactttactttacgttacgtaacgtacgtacgtacggtacgtacgtaccggtacccgttacggttcggttaccggttaccggtaccggtaaccgggtaaccggtaacgggtaacggtaacgttaaccggtaaccggtaacggttacggtacggtaccgtacggtaccgtaccgttacgttaccgttacgttaccgttaccgttaccgttcccg

SEQ ID NO: 282684 - DNA, 154 bp, Homo sapiens; identical to SEQ ID NO: 281552
  misc_feature: GYAE6OF02GE0DC.1.24.C02.1.454.CMB.1.raw
  modified_base (154)..(154): a, c, t, g, unknown or other
  misc_feature (154)..(154): n is a, c, g, or t

SEQ ID NO: 282685 - DNA, 154 bp, Homo sapiens; identical to SEQ ID NO: 281552
  misc_feature: GYAE6OF02FZVLN.1.24.C02.1.454.CMB.1.raw
  modified_base (154)..(154): a, c, t, g, unknown or other
  misc_feature (154)..(154): n is a, c, g, or t

SEQ ID NO: 282686 - DNA, 154 bp, Homo sapiens; identical to SEQ ID NO: 281552
  misc_feature: GYAE6OF02GVWH7.1.24.C02.1.454.CMB.1.raw
  modified_base (154)..(154): a, c, t, g, unknown or other
  misc_feature (154)..(154): n is a, c, g, or t

SEQ ID NO: 282687 - DNA, 154 bp, Homo sapiens; identical to SEQ ID NO: 281604
  misc_feature: GYAE6OF02GOMHJ.1.24.C02.1.454.CMB.1.raw
  modified_base (154)..(154): a, c, t, g, unknown or other
  misc_feature (154)..(154): n is a, c, g, or t

SEQ ID NO: 282688 - DNA, 190 bp, Homo sapiens
  misc_feature: GYAE6OF02HK23X.1.24.C02.1.454.CMB.1.raw
  modified_base (158)..(190): a, c, t, g, unknown or other
  misc_feature (158)..(190): n is a, c, g, or t
tcagacgagtgcgtcacgaccggtgctcgatttagtacagatcgttagggaaagggaccgaagggtggagatcaaacgaactgtggctgcaccatctgtcttccatcttcccgccctcctcgacgtctactgctgagcgggctggcaaggcgcatagnnnnnnnnnnnnnnnnnnnnnnnnnnnnnnnnn

SEQ ID NO: 282689 - DNA, 172 bp, Homo sapiens
  misc_feature: GYAE6OF02HSRCC.1.24.C02.1.454.CMB.1.raw
  modified_base (155)..(172): a, c, t, g, unknown or other
  misc_feature (155)..(172): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctaggcaaggcgcatagnnnnnnnnnnnnnnnnnn

SEQ ID NO: 282690 - DNA, 154 bp, Homo sapiens; identical to SEQ ID NO: 281783
  misc_feature: GYAE6OF02H0JN6.1.24.C02.1.454.CMB.1.raw
  modified_base (154)..(154): a, c, t, g, unknown or other
  misc_feature (154)..(154): n is a, c, g, or t

SEQ ID NO: 282691 - DNA, 154 bp, Homo sapiens; identical to SEQ ID NO: 281604
  misc_feature: GYAE6OF02FQJVH.1.24.C02.1.454.CMB.1.raw
  modified_base (154)..(154): a, c, t, g, unknown or other
  misc_feature (154)..(154): n is a, c, g, or t

SEQ ID NO: 282692 - DNA, 155 bp, Homo sapiens; identical to SEQ ID NO: 281555
  misc_feature: GYAE6OF02FNWLJ.1.24.C02.1.454.CMB.1.raw
  modified_base (154)..(155): a, c, t, g, unknown or other
  misc_feature (154)..(155): n is a, c, g, or t

SEQ ID NO: 282693 - DNA, 154 bp, Homo sapiens; identical to SEQ ID NO: 281604
  misc_feature: GYAE6OF02HOJCI.1.24.C02.1.454.CMB.1.raw
  modified_base (154)..(154): a, c, t, g, unknown or other
  misc_feature (154)..(154): n is a, c, g, or t

SEQ ID NO: 282694 - DNA, 155 bp, Homo sapiens; identical to SEQ ID NO: 281693
  misc_feature: GYAE6OF02IZTLN.1.24.C02.1.454.CMB.1.raw
  modified_base (154)..(155): a, c, t, g, unknown or other
  misc_feature (154)..(155): n is a, c, g, or t

SEQ ID NO: 282695 - DNA, 155 bp, Homo sapiens; identical to SEQ ID NO: 281668
  misc_feature: GYAE6OF02G6EBK.1.24.C02.1.454.CMB.1.raw
  modified_base (154)..(155): a, c, t, g, unknown or other
  misc_feature (154)..(155): n is a, c, g, or t

SEQ ID NO: 282696 - DNA, 155 bp, Homo sapiens; identical to SEQ ID NO: 281575
  misc_feature: GYAE6OF02GA99U.1.24.C02.1.454.CMB.1.raw
  modified_base (154)..(155): a, c, t, g, unknown or other
  misc_feature (154)..(155): n is a, c, g, or t

SEQ ID NO: 282697 - DNA, 154 bp, Homo sapiens; identical to SEQ ID NO: 281576
  misc_feature: GYAE6OF02H7862.1.24.C02.1.454.CMB.1.raw
  modified_base (154)..(154): a, c, t, g, unknown or other
  misc_feature (154)..(154): n is a, c, g, or t

SEQ ID NO: 282698 - DNA, 155 bp, Homo sapiens; identical to SEQ ID NO: 281555
  misc_feature: GYAE6OF02FRF14.1.24.C02.1.454.CMB.1.raw
  modified_base (154)..(155): a, c, t, g, unknown or other
  misc_feature (154)..(155): n is a, c, g, or t

SEQ ID NO: 282699 - DNA, 154 bp, Homo sapiens; identical to SEQ ID NO: 281552
  misc_feature: GYAE6OF02JCKF0.1.24.C02.1.454.CMB.1.raw
  modified_base (154)..(154): a, c, t, g, unknown or other
  misc_feature (154)..(154): n is a, c, g, or t

SEQ ID NO: 282700 - DNA, 181 bp, Homo sapiens
  misc_feature: GYAE6OF02HCAKT.1.24.C02.1.454.CMB.1.raw
  modified_base (156)..(181): a, c, t, g, unknown or other
  misc_feature (156)..(181): n is a, c, g, or t
tcagacgagtgcgtcacgaccggtgctcgatttagtacagatcgttagggcgaagggaccaaggtcgtagatcaaacgaactgtggctgcaccatctgtcttcatcttcccgccatctgaatagcgtactctgagcgggctggcaaggcgcatagnnnnnnnnnnnnnnnnnnnnnnnnnn

SEQ ID NO: 282701 - DNA, 154 bp, Homo sapiens
  misc_feature: GYAE6OF02FFSRI.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccacctcctcacgtagcgtgctgagcgggctggcaaggcgcatagnn

SEQ ID NO: 282702 - DNA, 155 bp, Homo sapiens
  misc_feature: GYAE6OF02G9R9E.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgcactcgtctgagcgggctggcaaggcgcatagnn

SEQ ID NO: 282703 - DNA, 155 bp, Homo sapiens; identical to SEQ ID NO: 281799
  misc_feature: GYAE6OF02HF8Z1.1.24.C02.1.454.CMB.1.raw
  modified_base (154)..(155): a, c, t, g, unknown or other
  misc_feature (154)..(155): n is a, c, g, or t

SEQ ID NO: 282704 - DNA, 155 bp, Homo sapiens
  misc_feature: GYAE6OF02GPFK4.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcatagnn

SEQ ID NO: 282705 - DNA, 155 bp, Homo sapiens; identical to SEQ ID NO: 281799
  misc_feature: GYAE6OF02F1XCH.1.24.C02.1.454.CMB.1.raw
  modified_base (154)..(155): a, c, t, g, unknown or other
  misc_feature (154)..(155): n is a, c, g, or t

SEQ ID NO: 282706 - DNA, 160 bp, Homo sapiens
  misc_feature: GYAE6OF02I3WJE.1.24.C02.1.454.CMB.1.raw
  modified_base (99)..(99): a, c, t, g, unknown or other
  misc_feature (99)..(99): n is a, c, g, or t
  modified_base (160)..(160): a, c, t, g, unknown or other
  misc_feature (160)..(160): n is a, c, g, or t
tcagacgagtgcgtcacgaccggtgctcgatttagtacagatcgttagggaaagggaccaaggtggagatcaaacgaactgtggctgcaccttttttanctgtcttcatcttcccgccatctgactcgcgatatctgagcgggctggcaaggcgcatagn

SEQ ID NO: 282707 - DNA, 154 bp, Homo sapiens
  misc_feature: GYAE6OF02HIXP4.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaacgtctactgctgagcgggctggcaaggcgcatagn

SEQ ID NO: 282708 - DNA, 155 bp, Homo sapiens; identical to SEQ ID NO: 282704
  misc_feature: GYAE6OF02GXDQC.1.24.C02.1.454.CMB.1.raw
  modified_base (154)..(155): a, c, t, g, unknown or other
  misc_feature (154)..(155): n is a, c, g, or t

SEQ ID NO: 282709 - DNA, 177 bp, Homo sapiens
  misc_feature: GYAE6OF02H4NMM.1.24.C02.1.454.CMB.1.raw
  modified_base (155)..(177): a, c, t, g, unknown or other
  misc_feature (155)..(177): n is a, c, g, or t
tcagacgagtgcgtcacgaccggtgctcgatttagtacagatcgttagggcgaagggaccaaggtgtagatcaaacgaactgtggctgcaccatctgtcttcatcttcccgccatctgaatagcgtactctgagcgggctggcaaggcgcatagnnnnnnnnnnnnnnnnnnnnnnn

SEQ ID NO: 282710 - DNA, 154 bp, Homo sapiens
  misc_feature: GYAE6OF02GS0AX.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaactaactgtggctgcaccatctgtcttcatcttcccgccatctgatcgtactgcgctgagcgggctggcaaggcgcatagn

SEQ ID NO: 282711 - DNA, 153 bp, Homo sapiens
  misc_feature: GYAE6OF02I79YM.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggaaagggaccaaggtggagatcaaacgaactgtggctgcaccatctgtcttcatcttcccgccactgatatgtatactctgagcgggctggcaaggcgcatagn

SEQ ID NO: 282712 - DNA, 154 bp, Homo sapiens; identical to SEQ ID NO: 281569
  misc_feature: GYAE6OF02F7V3R.1.24.C02.1.454.CMB.1.raw
  modified_base (154)..(154): a, c, t, g, unknown or other
  misc_feature (154)..(154): n is a, c, g, or t

SEQ ID NO: 282713 - DNA, 154 bp, Homo sapiens; identical to SEQ ID NO: 281552
  misc_feature: GYAE6OF02FH6AU.1.24.C02.1.454.CMB.1.raw
  modified_base (154)..(154): a, c, t, g, unknown or other
  misc_feature (154)..(154): n is a, c, g, or t

SEQ ID NO: 282714 - DNA, 154 bp, Homo sapiens; identical to SEQ ID NO: 281569
  misc_feature: GYAE6OF02G3JZR.1.24.C02.1.454.CMB.1.raw
  modified_base (154)..(154): a, c, t, g, unknown or other
  misc_feature (154)..(154): n is a, c, g, or t

SEQ ID NO: 282715 - DNA, 192 bp, Homo sapiens
  misc_feature: GYAE6OF02FUYT9.1.24.C02.1.454.CMB.1.raw
  modified_base (133)..(133): a, c, t, g, unknown or other
  misc_feature (133)..(133): n is a, c, g, or t
  modified_base (158)..(159): a, c, t, g, unknown or other
  misc_feature (158)..(159): n is a, c, g, or t
  modified_base (161)..(161): a, c, t, g, unknown or other
  misc_feature (161)..(161): n is a, c, g, or t
  modified_base (163)..(192): a, c, t, g, unknown or other
  misc_feature (163)..(192): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgancgggctggccaaagggcgcattagnnancnnnnnnnnnnnnnnnnnnnnnnnnnnnnnn

SEQ ID NO: 282716 - DNA, 161 bp, Homo sapiens
  misc_feature: GYAE6OF02HB02I.1.24.C02.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacagatcgttagggcaagggaccaaggtggagatcaaacgaactgtggcgtgcaccatctgtcttcatcttcccgccatctgatatgtatactctgagcgggctggcaaggcgcatagnnnnnnn

SEQ ID NO: 282717 - DNA, 168 bp, Homo sapiens
  misc_feature: GYAE6OF02J3QTE.1.24.C02.1.454.CMB.1.raw
  modified_base (143)..(143): a, c, t, g, unknown or other
  misc_feature (143)..(143): n is a, c, g, or t
  modified_base (149)..(168): a, c, t, g, unknown or other
  misc_feature (149)..(168): n is a, c, g, or t
tcagacgagtgcgtcacgaccggtgctcgatttagtacagatcgttagggaagtgaccaaggtgagatcaactaactgtggctgcaccatctgtcttcatcttcccgcatctgatcgtactgcgctgagcggctggcaaggcncatagnnnnnnnnnnnnnnnnnnnn

SEQ ID NO: 282718 - DNA, 165 bp, Homo sapiens
  misc_feature: GYAE6OF02F5GED.1.24.C02.1.454.CMB.1.raw
  modified_base (155)..(165): a, c, t, g, unknown or other
  misc_feature (155)..(165): n is a, c, g, or t
tcagacgagtgcgtcacgaccggtgctcgatttagtacagatcgttagggcaagggaccaaggtggagatcaaacgaactgtggcctgaaccatctgtcttcatcttcccgccatctgaatagcgtactctgagcgggctggcaaggcgcatagnnnnnnnnnnn

SEQ ID NO: 282719 - DNA, 155 bp, Homo sapiens; identical to SEQ ID NO: 281555
  misc_feature: GYAE6OF02F2J6R.1.24.C02.1.454.CMB.1.raw
  modified_base (154)..(155): a, c, t, g, unknown or other
  misc_feature (154)..(155): n is a, c, g, or t

SEQ ID NO: 282720 - DNA, 154 bp, Homo sapiens; identical to SEQ ID NO: 281641
  misc_feature: GYAE6OF02H4BAZ.1.24.C02.1.454.CMB.1.raw
  modified_base (154)..(154): a, c, t, g, unknown or other
  misc_feature (154)..(154): n is a, c, g, or t

SEQ ID NO: 282721 - DNA, 168 bp, Homo sapiens
  misc_feature: GYAE6OF02IUD2Y.1.24.C02.1.454.CMB.1.raw
  modified_base (156)..(168): a, c, t, g, unknown or other
  misc_feature (156)..(168): n is a, c, g, or t
tcagacgagtgcgtcacgaccggtgctcgatttagtacagatcgttagggcaagggaccgaaggtggagatcaaacgaactgtggctgcaccatctgtcttcatcttcccgccatctgaatagcgtactctgagcgggctgggcaaggcgcatagnnnnnnnnnnnnn

SEQ ID NO: 282722 - DNA, 191 bp, Homo sapiens
  misc_feature: GYAE6OF02GXKP8.1.24.C02.1.454.CMB.1.raw
  modified_base (155)..(191): a, c, t, g, unknown or other
  misc_feature (155)..(191): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnnnnnnnnnnnnnnnnnnnnnnnnnnnnnnnnnnn

SEQ ID NO: 282723 - DNA, 162 bp, Homo sapiens; identical to SEQ ID NO: 281628
  misc_feature: GYAE6OF02GWYSX.1.24.C02.1.454.CMB.1.raw
  modified_base (154)..(162): a, c, t, g, unknown or other
  misc_feature (154)..(162): n is a, c, g, or t

SEQ ID NO: 282724 - DNA, 154 bp, Homo sapiens; identical to SEQ ID NO: 281569
  misc_feature: GYAE6OF02IGF9I.1.24.C02.1.454.CMB.1.raw
  modified_base (154)..(154): a, c, t, g, unknown or other
  misc_feature (154)..(154): n is a, c, g, or t

SEQ ID NO: 282725 - DNA, 154 bp, Homo sapiens; identical to SEQ ID NO: 281604
  misc_feature: GYAE6OF02IWL5O.1.24.C02.1.454.CMB.1.raw
  modified_base (154)..(154): a, c, t, g, unknown or other
  misc_feature (154)..(154): n is a, c, g, or t

SEQ ID NO: 282726 - DNA, 157 bp, Homo sapiens; identical to SEQ ID NO: 282630
  misc_feature: GYAE6OF02JQ3MC.1.24.C02.1.454.CMB.1.raw
  modified_base (154)..(157): a, c, t, g, unknown or other
  misc_feature (154)..(157): n is a, c, g, or t

SEQ ID NO: 282727 - DNA, 185 bp, Homo sapiens
  misc_feature: GYAE6OF02H78RL.1.24.C02.1.454.CMB.1.raw
  modified_base (158)..(185): a, c, t, g, unknown or other
  misc_feature (158)..(185): n is a, c, g, or t
tcagacgagtgcgtcacgaccggtgctcgatttagtacagatcgttagggaaagggaccgaaggtgggagatcaaacggaactgtggctgcaccatctgtcttcatcttcccaccctctcacgcactcgtctgagcgggctgggcaaggcgcatagcnnnnnnnnnnnnnnnnnnnnnnnnnnnn

SEQ ID NO: 282728 - DNA, 178 bp, Homo sapiens
  misc_feature: GYAE6OF02FJ432.1.24.C02.1.454.CMB.1.raw
  modified_base (155)..(178): a, c, t, g, unknown or other
  misc_feature (155)..(178): n is a, c, g, or t
tcagacgagtgcgtcacgaccggtgctcgatttagtacagatcgttagggaaagggaccaaggtggagatcaaacgaactgttgctgcaccatctgtcttcatcttcccgccatcctgatcgtagcactctgagcgggctggcaaggcgcatagnnnnnnnnnnnnnnnnnnnnnnnn

SEQ ID NO: 282729 - DNA, 155 bp, Homo sapiens; identical to SEQ ID NO: 282170
  misc_feature: GYAE6OF02GWTX3.1.24.C02.1.454.CMB.1.raw
  modified_base (154)..(155): a, c, t, g, unknown or other
  misc_feature (154)..(155): n is a, c, g, or t

SEQ ID NO: 282730 - DNA, 156 bp, Homo sapiens; identical to SEQ ID NO: 281595
  misc_feature: GYAE6OF02IM2TB.1.24.C02.1.454.CMB.1.raw
  modified_base (154)..(156): a, c, t, g, unknown or other
  misc_feature (154)..(156): n is a, c, g, or t

SEQ ID NO: 282731 - DNA, 162 bp, Homo sapiens
  misc_feature: GYAE6OF02I3KKY.1.24.C02.1.454.CMB.1.raw
  modified_base (133)..(133): a, c, t, g, unknown or other
  misc_feature (133)..(133): n is a, c, g, or t
  modified_base (155)..(162): a, c, t, g, unknown or other
  misc_feature (155)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatgcgtactctggancgggctggcaaggcgcattagnnnnnnnn

SEQ ID NO: 282732 - DNA, 181 bp, Homo sapiens
  misc_feature: GYAE6OF02HHBZ9.1.24.C02.1.454.CMB.1.raw
  modified_base (157)..(163): a, c, t, g, unknown or other
  misc_feature (157)..(163): n is a, c, g, or t
  modified_base (165)..(181): a, c, t, g, unknown or other
  misc_feature (165)..(181): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggcaaggcgccagtaggnnnnnnntnnnnnnnnnnnnnnnnn

SEQ ID NO: 282733 - DNA, 161 bp, Homo sapiens
  misc_feature: GYAE6OF02HXWXW.1.24.C02.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacagatcgttagggaaagggaccaaggtggagatcaaacggaactgtggctgcaccatctgtcttcatcttcccgccatctgatatacgatcgctgagcgggctggcaaggcgcatagnnnnnnn

SEQ ID NO: 282734 - DNA, 168 bp, Homo sapiens
  misc_feature: GYAE6OF02HEIRJ.1.24.C02.1.454.CMB.1.raw
  modified_base (156)..(168): a, c, t, g, unknown or other
  misc_feature (156)..(168): n is a, c, g, or t
tcagacgagtgcgtcacgaccggtgctcgatttagtacagatcgttagggcgaagggaaccaaggtcggagatcaaacgaactgtggctgcaccatctgtcttcatcttccgccatctgaatagcgtactctgagcgggctggcaaggcgcatagnnnnnnnnnnnnn

SEQ ID NO: 282735 - DNA, 154 bp, Homo sapiens; identical to SEQ ID NO: 281552
  misc_feature: GYAE6OF02HBITG.1.24.C02.1.454.CMB.1.raw
  modified_base (154)..(154): a, c, t, g, unknown or other
  misc_feature (154)..(154): n is a, c, g, or t

SEQ ID NO: 282736 - DNA, 153 bp, Homo sapiens; identical to SEQ ID NO: 282155
  misc_feature: GYAE6OF02H98G3.1.24.C02.1.454.CMB.1.raw

SEQ ID NO: 282737 - DNA, 154 bp, Homo sapiens; identical to SEQ ID NO: 281572
  misc_feature: GYAE6OF02GQWXZ.1.24.C02.1.454.CMB.1.raw
  modified_base (154)..(154): a, c, t, g, unknown or other
  misc_feature (154)..(154): n is a, c, g, or t

SEQ ID NO: 282738 - DNA, 173 bp, Homo sapiens
  misc_feature: GYAE6OF02GHL0Z.1.24.C02.1.454.CMB.1.raw
  modified_base (155)..(173): a, c, t, g, unknown or other
  misc_feature (155)..(173): n is a, c, g, or t
tcagacgagtgcgtcacgaccggtgctcgatttagtacagatcgttagggcaaggggaccaaggtggagatcaaacgaactgtggctgcaccatctgtcttcatcttcccgccatctgaatagcgtactctgagcgggctggcaaggcgcatagnnnnnnnnnnnnnnnnnnn

SEQ ID NO: 282739 - DNA, 155 bp, Homo sapiens; identical to SEQ ID NO: 281555
  misc_feature: GYAE6OF02FS0RI.1.24.C02.1.454.CMB.1.raw
  modified_base (154)..(155): a, c, t, g, unknown or other
  misc_feature (154)..(155): n is a, c, g, or t

SEQ ID NO: 282740 - DNA, 155 bp, Homo sapiens; identical to SEQ ID NO: 281555
  misc_feature: GYAE6OF02F4YQ0.1.24.C02.1.454.CMB.1.raw
  modified_base (154)..(155): a, c, t, g, unknown or other
  misc_feature (154)..(155): n is a, c, g, or t

SEQ ID NO: 282741 - DNA, 155 bp, Homo sapiens; identical to SEQ ID NO: 281931
  misc_feature: GYAE6OF02GGZK5.1.24.C02.1.454.CMB.1.raw
  modified_base (154)..(155): a, c, t, g, unknown or other
  misc_feature (154)..(155): n is a, c, g, or t

SEQ ID NO: 282742 - DNA, 158 bp, Homo sapiens
  misc_feature: GYAE6OF02H5HOL.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctgagcgggctggcaaggcgcatagnnnnn

SEQ ID NO: 282743 - DNA, 154 bp, Homo sapiens; identical to SEQ ID NO: 281569
  misc_feature: GYAE6OF02ITV90.1.24.C02.1.454.CMB.1.raw
  modified_base (154)..(154): a, c, t, g, unknown or other
  misc_feature (154)..(154): n is a, c, g, or t

SEQ ID NO: 282744 - DNA, 170 bp, Homo sapiens
  misc_feature: GYAE6OF02F2Q7Z.1.24.C02.1.454.CMB.1.raw
  modified_base (155)..(170): a, c, t, g, unknown or other
  misc_feature (155)..(170): n is a, c, g, or t
tcagacgagtgcgtcacgaccggtgctcgatttagtacagatcgttagggaaaggggaccaaggtggagatcaaacgaactgtggctgcaccatctgtcttcatcttcccgccatctgatcgtagcactctgagcgggctggcaaggcgcatagnnnnnnnnnnnnnnnn

SEQ ID NO: 282745 - DNA, 154 bp, Homo sapiens; identical to SEQ ID NO: 281552
  misc_feature: GYAE6OF02IBQ6I.1.24.C02.1.454.CMB.1.raw
  modified_base (154)..(154): a, c, t, g, unknown or other
  misc_feature (154)..(154): n is a, c, g, or t

SEQ ID NO: 282746 - DNA, 156 bp, Homo sapiens; identical to SEQ ID NO: 281762
  misc_feature: GYAE6OF02IUDBY.1.24.C02.1.454.CMB.1.raw
  modified_base (154)..(156): a, c, t, g, unknown or other
  misc_feature (154)..(156): n is a, c, g, or t

SEQ ID NO: 282747 - DNA, 163 bp, Homo sapiens
  misc_feature: GYAE6OF02FSA01.1.24.C02.1.454.CMB.1.raw
  modified_base (156)..(163): a, c, t, g, unknown or other
  misc_feature (156)..(163): n is a, c, g, or t
tcagacgagtgcgtcacgaccggtgctcgatttagtacagatcgttagggcaagggaccaaggtggagatcaaacgaactgtggctgcaccatctggtcttcatcttcccgccatctgaatagcgtactctgagcgggctggcaaggcgccatagnnnnnnnn

SEQ ID NO: 282748 - DNA, 155 bp, Homo sapiens; identical to SEQ ID NO: 281555
  misc_feature: GYAE6OF02IA6II.1.24.C02.1.454.CMB.1.raw
  modified_base (154)..(155): a, c, t, g, unknown or other
  misc_feature (154)..(155): n is a, c, g, or t

SEQ ID NO: 282749 - DNA, 157 bp, Homo sapiens; identical to SEQ ID NO: 282522
  misc_feature: GYAE6OF02G0XNM.1.24.C02.1.454.CMB.1.raw
  modified_base (154)..(157): a, c, t, g, unknown or other
  misc_feature (154)..(157): n is a, c, g, or t

SEQ ID NO: 282750 - DNA, 156 bp, Homo sapiens; identical to SEQ ID NO: 281661
  misc_feature: GYAE6OF02G64RV.1.24.C02.1.454.CMB.1.raw
  modified_base (154)..(156): a, c, t, g, unknown or other
  misc_feature (154)..(156): n is a, c, g, or t

SEQ ID NO: 282751 - DNA, 154 bp, Homo sapiens; identical to SEQ ID NO: 281706
  misc_feature: GYAE6OF02HZ01M.1.24.C02.1.454.CMB.1.raw
  modified_base (154)..(154): a, c, t, g, unknown or other
  misc_feature (154)..(154): n is a, c, g, or t

SEQ ID NO: 282752 - DNA, 154 bp, Homo sapiens; identical to SEQ ID NO: 281614
  misc_feature: GYAE6OF02GGFWG.1.24.C02.1.454.CMB.1.raw
  modified_base (154)..(154): a, c, t, g, unknown or other
  misc_feature (154)..(154): n is a, c, g, or t

SEQ ID NO: 282753 - DNA, 157 bp, Homo sapiens
  misc_feature: GYAE6OF02F3RWY.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggaaagggaccaaggtggaaatcaaacgaactgtggctgcaccatctgtcttcatcttcccgccatctgaacgcactcgtctgagcgggctggcaaggcgcatagnnnn

SEQ ID NO: 282754 - DNA, 153 bp, Homo sapiens; identical to SEQ ID NO: 281577
  misc_feature: GYAE6OF02FFV9S.1.24.C02.1.454.CMB.1.raw
  modified_base (153)..(153): a, c, t, g, unknown or other
  misc_feature (153)..(153): n is a, c, g, or t

SEQ ID NO: 282755 - DNA, 156 bp, Homo sapiens; identical to SEQ ID NO: 281595
  misc_feature: GYAE6OF02H01N9.1.24.C02.1.454.CMB.1.raw
  modified_base (154)..(156): a, c, t, g, unknown or other
  misc_feature (154)..(156): n is a, c, g, or t

SEQ ID NO: 282756 - DNA, 154 bp, Homo sapiens
  misc_feature: GYAE6OF02FFREM.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggaagggaccaaggtggagatcaaacgactgtggctgcaccatctgtcttcatcttcccgccatctgatatgtatactctgagcgggctaggcaaggcgcatagnn

SEQ ID NO: 282757 - DNA, 160 bp, Homo sapiens; identical to SEQ ID NO: 281714
  misc_feature: GYAE6OF02JK27C.1.24.C02.1.454.CMB.1.raw
  modified_base (154)..(160): a, c, t, g, unknown or other
  misc_feature (154)..(160): n is a, c, g, or t

SEQ ID NO: 282758 - DNA, 159 bp, Homo sapiens
  misc_feature: GYAE6OF02HDLU3.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgcatagnnnnnn

SEQ ID NO: 282759 - DNA, 156 bp, Homo sapiens
  misc_feature: GYAE6OF02JF8OM.1.24.C02.1.454.CMB.1.raw
  modified_base (134)..(134): a, c, t, g, unknown or other
  misc_feature (134)..(134): n is a, c, g, or t
  modified_base (155)..(156): a, c, t, g, unknown or other
  misc_feature (155)..(156): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgaatagcgtactctgancgggctggcaaggcgcatagnn

SEQ ID NO: 282760 - DNA, 163 bp, Homo sapiens
  misc_feature: GYAE6OF02FU2JG.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgacctcgcgatatctgagcgggctggcaaggcgcatagnnnnnnnnn

SEQ ID NO: 282761 - DNA, 154 bp, Homo sapiens; identical to SEQ ID NO: 281569
  misc_feature: GYAE6OF02F1Y1B.1.24.C02.1.454.CMB.1.raw
  modified_base (154)..(154): a, c, t, g, unknown or other
  misc_feature (154)..(154): n is a, c, g, or t

SEQ ID NO: 282762 - DNA, 174 bp, Homo sapiens
  misc_feature: GYAE6OF02FUEUL.1.24.C02.1.454.CMB.1.raw
  modified_base (156)..(174): a, c, t, g, unknown or other
  misc_feature (156)..(174): n is a, c, g, or t
tcagacgagtgcgtcacgaccggtgctcgatttagtacagatcgttagggaaagggaccaaggtggagtatcaaacgaactgtggctgcaccatctgtcttcatcttcccaccctcctctctctcgactctgagcgggctggccaaggcgcatagnnnnnnnnnnnnnnnnnnn

SEQ ID NO: 282763 - DNA, 214 bp, Homo sapiens
  misc_feature: GYAE6OF02GONVH.1.24.C02.1.454.CMB.1.raw
  modified_base (159)..(214): a, c, t, g, unknown or other
  misc_feature (159)..(214): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtagcggtgctgagcgggtctgggcaaggccgcaatagnnnnnnnnnnnnnnnnnnnnnnnnnnnnnnnnnnnnnnnnnnnnnnnnnnnnnnnn

SEQ ID NO: 282764 - DNA, 166 bp, Homo sapiens
  misc_feature: GYAE6OF02IEE4P.1.24.C02.1.454.CMB.1.raw
  modified_base (153)..(166): a, c, t, g, unknown or other
  misc_feature (153)..(166): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnnnnnnnnnnnnnn

SEQ ID NO: 282765 - DNA, 156 bp, Homo sapiens; identical to SEQ ID NO: 281661
  misc_feature: GYAE6OF02FOSVN.1.24.C02.1.454.CMB.1.raw
  modified_base (154)..(156): a, c, t, g, unknown or other
  misc_feature (154)..(156): n is a, c, g, or t

SEQ ID NO: 282766 - DNA, 165 bp, Homo sapiens
  misc_feature: GYAE6OF02HQFPT.1.24.C02.1.454.CMB.1.raw
  modified_base (155)..(165): a, c, t, g, unknown or other
  misc_feature (155)..(165): n is a, c, g, or t
tcagacgagtgcgtcacgaccggtgctcgatttagtacagatcgttagagaaagggaccaaggtggagatcaaacgaactgtggctgcaccatctgtcttcatcttcccgccatctgaatagcgtactctgagcgggctggcaaggacgcatagnnnnnnnnnnn

SEQ ID NO: 282767 - DNA, 155 bp, Homo sapiens; identical to SEQ ID NO: 281555
  misc_feature: GYAE6OF02F3S4B.1.24.C02.1.454.CMB.1.raw
  modified_base (154)..(155): a, c, t, g, unknown or other
  misc_feature (154)..(155): n is a, c, g, or t

SEQ ID NO: 282768 - DNA, 155 bp, Homo sapiens
  misc_feature: GYAE6OF02H879Z.1.24.C02.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctgggcaaggcgcatagn

SEQ ID NO: 282769 - DNA, 156 bp, Homo sapiens; identical to SEQ ID NO: 281741
  misc_feature: GYAE6OF02IV4BH.1.24.C02.1.454.CMB.1.raw
  modified_base (154)..(156): a, c, t, g, unknown or other
  misc_feature (154)..(156): n is a, c, g, or t

SEQ ID NO: 282770 - DNA, 154 bp, Homo sapiens
  misc_feature: GYAE6OF02H5W1N.1.24.C02.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtacctgagcgggctggcaaggcgcatagnn

SEQ ID NO: 282771 - DNA, 154 bp, Homo sapiens; identical to SEQ ID NO: 281552
  misc_feature: GYAE6OF02GCCVX.1.24.C02.1.454.CMB.1.raw
  modified_base (154)..(154): a, c, t, g, unknown or other
  misc_feature (154)..(154): n is a, c, g, or t

SEQ ID NO: 282772 - DNA, 157 bp, Homo sapiens
  misc_feature: GYAE6OF02IP3UQ.1.24.C02.1.454.CMB.1.raw
  modified_base (153)..(157): a, c, t, g, unknown or other
  misc_feature (153)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatcgtagcactctgagcgggctggcaaggcgcatagnnnnn

SEQ ID NO: 282773 - DNA, 154 bp, Homo sapiens; identical to SEQ ID NO: 281607
  misc_feature: GYAE6OF02FOS92.1.24.C02.1.454.CMB.1.raw
  modified_base (154)..(154): a, c, t, g, unknown or other
  misc_feature (154)..(154): n is a, c, g, or t

SEQ ID NO: 282774 - DNA, 154 bp, Homo sapiens; identical to SEQ ID NO: 281609
  misc_feature: GYAE6OF02JDR44.1.24.C02.1.454.CMB.1.raw
  modified_base (154)..(154): a, c, t, g, unknown or other
  misc_feature (154)..(154): n is a, c, g, or t

SEQ ID NO: 282775 - DNA, 176 bp, Homo sapiens
  misc_feature: GYAE6OF02GT2G8.1.24.C02.1.454.CMB.1.raw
  modified_base (101)..(101): a, c, t, g, unknown or other
  misc_feature (101)..(101): n is a, c, g, or t
  modified_base (154)..(176): a, c, t, g, unknown or other
  misc_feature (154)..(176): n is a, c, g, or t
tcagacgagtgcgtcacgaccggtgctcgatttagtacagatcgttagggcaagggaccaaggtggagatcaaacgaactgtggctgcaccatctgtcttnatcttcccgccatctgaatagcgtactctgagcgggctggcaaggcgcatagnnnnnnnnnnnnnnnnnnnnnnn

SEQ ID NO: 282776 - DNA, 155 bp, Homo sapiens; identical to SEQ ID NO: 281799
  misc_feature: GYAE6OF02GYMS4.1.24.C02.1.454.CMB.1.raw
  modified_base (154)..(155): a, c, t, g, unknown or other
  misc_feature (154)..(155): n is a, c, g, or t

SEQ ID NO: 282777 - DNA, 152 bp, Homo sapiens
  misc_feature: GYAE6OF02JOWS8.1.24.C02.1.454.CMB.1.raw
  modified_base (150)..(152): a, c, t, g, unknown or other
  misc_feature (150)..(152): n is a, c, g, or t
tcagacgagtgcgtcacgaccggtgctcgatttagtacagatcgttagtgcaaggaccaaggtggagatcaacgaactgtggctgcaccatctgtcttcatcttccgccatctgactcgtctctactgagcggctggcaaggcgcatagnnn

SEQ ID NO: 282778 - DNA, 155 bp, Homo sapiens; identical to SEQ ID NO: 281907
  misc_feature: GYAE6OF02FUW9M.1.24.C02.1.454.CMB.1.raw
  modified_base (154)..(155): a, c, t, g, unknown or other
  misc_feature (154)..(155): n is a, c, g, or t

SEQ ID NO: 282779 - DNA, 154 bp, Homo sapiens; identical to SEQ ID NO: 281552
  misc_feature: GYAE6OF02GQ0N5.1.24.C02.1.454.CMB.1.raw
  modified_base (154)..(154): a, c, t, g, unknown or other
  misc_feature (154)..(154): n is a, c, g, or t

SEQ ID NO: 282780 - DNA, 154 bp, Homo sapiens; identical to SEQ ID NO: 281569
  misc_feature: GYAE6OF02IZ3FD.1.24.C02.1.454.CMB.1.raw
  modified_base (154)..(154): a, c, t, g, unknown or other
  misc_feature (154)..(154): n is a, c, g, or t

SEQ ID NO: 282781 - DNA, 155 bp, Homo sapiens
  misc_feature: GYAE6OF02F8TWC.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgtggctgcaccatctgttttcatcttcccgccatctgatatgtatactctgagcgggctggcaaggcgcatagnn

SEQ ID NO: 282782 - DNA, 154 bp, Homo sapiens; identical to SEQ ID NO: 281572
  misc_feature: GYAE6OF02GABF3.1.24.C02.1.454.CMB.1.raw
  modified_base (154)..(154): a, c, t, g, unknown or other
  misc_feature (154)..(154): n is a, c, g, or t

SEQ ID NO: 282783 - DNA, 156 bp, Homo sapiens
  misc_feature: GYAE6OF02JE364.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaactaactgtggctgcacaatctgtcttcatcttcccgccatctgatcgtactgcgctgagcgggctggcaaggcgcatagnnn

SEQ ID NO: 282784 - DNA, 162 bp, Homo sapiens
  misc_feature: GYAE6OF02INFBV.1.24.C02.1.454.CMB.1.raw
  modified_base (157)..(162): a, c, t, g, unknown or other
  misc_feature (157)..(162): n is a, c, g, or t
tcagacgagtgcgtcacgaccggtgctcgatttagtacagatcgttagggcgaagggaccgaaggtggagatcaaacgaactagtggctgcaccatctgtcttcatcttcccgccatctgaatagcgtactctgagcgggctggcaaggcgcatagnnnnnn

SEQ ID NO: 282785 - DNA, 154 bp, Homo sapiens; identical to SEQ ID NO: 281552
  misc_feature: GYAE6OF02HGMME.1.24.C02.1.454.CMB.1.raw
  modified_base (154)..(154): a, c, t, g, unknown or other
  misc_feature (154)..(154): n is a, c, g, or t

SEQ ID NO: 282786 - DNA, 164 bp, Homo sapiens
  misc_feature: GYAE6OF02GGG24.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatcgtagcactctgagcgggctggcaaggcgcatagnnnnnnnnnnn

SEQ ID NO: 282787 - DNA, 155 bp, Homo sapiens; identical to SEQ ID NO: 281591
  misc_feature: GYAE6OF02HZ8ZP.1.24.C02.1.454.CMB.1.raw
  modified_base (154)..(155): a, c, t, g, unknown or other
  misc_feature (154)..(155): n is a, c, g, or t

SEQ ID NO: 282788 - DNA, 153 bp, Homo sapiens; identical to SEQ ID NO: 282002
  misc_feature: GYAE6OF02HVYFV.1.24.C02.1.454.CMB.1.raw

SEQ ID NO: 282789 - DNA, 163 bp, Homo sapiens
  misc_feature: GYAE6OF02IUD4V.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggaaagggaccgaaggtggagatcaaacgaactgtggctgcaccatctgtcttcatcttcccgccatctgatatacgatcgctgagcgggctggcaaggcgcatagnnnnnnnnn

SEQ ID NO: 282790 - DNA, 154 bp, Homo sapiens; identical to SEQ ID NO: 281569
  misc_feature: GYAE6OF02HEZC5.1.24.C02.1.454.CMB.1.raw
  modified_base (154)..(154): a, c, t, g, unknown or other
  misc_feature (154)..(154): n is a, c, g, or t

SEQ ID NO: 282791 - DNA, 161 bp, Homo sapiens
  misc_feature: GYAE6OF02HJ6KB.1.24.C02.1.454.CMB.1.raw
  modified_base (153)..(161): a, c, t, g, unknown or other
  misc_feature (153)..(161): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgaacgcattcgtctgagcgggctggcaaggcgcatagnnnnnnnnn

SEQ ID NO: 282792 - DNA, 154 bp, Homo sapiens; identical to SEQ ID NO: 281572
  misc_feature: GYAE6OF02HIV8I.1.24.C02.1.454.CMB.1.raw
  modified_base (154)..(154): a, c, t, g, unknown or other
  misc_feature (154)..(154): n is a, c, g, or t

SEQ ID NO: 282793 - DNA, 154 bp, Homo sapiens; identical to SEQ ID NO: 281604
  misc_feature: GYAE6OF02HAN2B.1.24.C02.1.454.CMB.1.raw
  modified_base (154)..(154): a, c, t, g, unknown or other
  misc_feature (154)..(154): n is a, c, g, or t

SEQ ID NO: 282794 - DNA, 155 bp, Homo sapiens; identical to SEQ ID NO: 281555
  misc_feature: GYAE6OF02I7I9N.1.24.C02.1.454.CMB.1.raw
  modified_base (154)..(155): a, c, t, g, unknown or other
  misc_feature (154)..(155): n is a, c, g, or t

SEQ ID NO: 282795 - DNA, 154 bp, Homo sapiens; identical to SEQ ID NO: 281576
  misc_feature: GYAE6OF02HLSO9.1.24.C02.1.454.CMB.1.raw
  modified_base (154)..(154): a, c, t, g, unknown or other
  misc_feature (154)..(154): n is a, c, g, or t

SEQ ID NO: 282796 - DNA, 153 bp, Homo sapiens; identical to SEQ ID NO: 282002
  misc_feature: GYAE6OF02GG66A.1.24.C02.1.454.CMB.1.raw

SEQ ID NO: 282797 - DNA, 153 bp, Homo sapiens; identical to SEQ ID NO: 282002
  misc_feature: GYAE6OF02H3265.1.24.C02.1.454.CMB.1.raw

SEQ ID NO: 282798 - DNA, 166 bp, Homo sapiens
  misc_feature: GYAE6OF02FFTZB.1.24.C02.1.454.CMB.1.raw
  modified_base (156)..(166): a, c, t, g, unknown or other
  misc_feature (156)..(166): n is a, c, g, or t
tcagacgagtgcgtcacgaccggtgctcgatttagtacagatcgttagggcaaggggaccaaggtggagatcaaacgaactgtggctgcaccatctgtcttcatcttcccgccatctgaatagcgtactctgagcgggctggcaaggtcgcatagnnnnnnnnnnn

SEQ ID NO: 282799 - DNA, 154 bp, Homo sapiens; identical to SEQ ID NO: 281552
  misc_feature: GYAE6OF02G5A1R.1.24.C02.1.454.CMB.1.raw
  modified_base (154)..(154): a, c, t, g, unknown or other
  misc_feature (154)..(154): n is a, c, g, or t

SEQ ID NO: 282800 - DNA, 543 bp, Homo sapiens
  misc_feature: GYAE6OF02H84RR.1.24.C02.1.454.CMB.1.raw
  modified_base (188)..(190): a, c, t, g, unknown or other
  misc_feature (188)..(190): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (204)..(209): a, c, t, g, unknown or other
  misc_feature (204)..(209): n is a, c, g, or t
  modified_base (211)..(211): a, c, t, g, unknown or other
  misc_feature (211)..(211): n is a, c, g, or t
  modified_base (213)..(214): a, c, t, g, unknown or other
  misc_feature (213)..(214): n is a, c, g, or t
  modified_base (216)..(216): a, c, t, g, unknown or other
  misc_feature (216)..(216): n is a, c, g, or t
  modified_base (218)..(219): a, c, t, g, unknown or other
  misc_feature (218)..(219): n is a, c, g, or t
  modified_base (222)..(222): a, c, t, g, unknown or other
  misc_feature (222)..(222): n is a, c, g, or t
  modified_base (227)..(230): a, c, t, g, unknown or other
  misc_feature (227)..(230): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
tcagacgagtgcgtcacgaccggtgctcgattttagtacagatcgttaaggggggcaagggaccaagggtggagatcaaacgaactggtggctcgccaccagtcctggtccttcatccttccccgccatcgtgaactagccgttactcgtgaaggcggggtcctgggacccaagggccgcaacttagnnncncncncncgcncnnnnnncncnncncnncanagacnnnngngtgtgtanantntntcncgacacacacancacacaccacananatatatgaganacagcgcncgcgtcngacgtcgtctctcgtcgtctctacgtcgtcgcgacgaccgccgtcctcgtccgtctcgtcgtcgcgacgtcgtgagngngagtcgtagtattactactcgtactactactatacacgacgtacggacgtacgtaccgttcggttcgggttcggtccggtacggaacggacgacgtacgtacgtacgtcgtacgtacgaccgtaccgacgccgtcccgtccgtaccgtcctaccgtccgtccg

SEQ ID NO: 282801 - DNA, 186 bp, Homo sapiens
  misc_feature: GYAE6OF02GCN6N.1.24.C02.1.454.CMB.1.raw
  modified_base (121)..(121): a, c, t, g, unknown or other
  misc_feature (121)..(121): n is a, c, g, or t
  modified_base (129)..(129): a, c, t, g, unknown or other
  misc_feature (129)..(129): n is a, c, g, or t
  modified_base (152)..(152): a, c, t, g, unknown or other
  misc_feature (152)..(152): n is a, c, g, or t
  modified_base (159)..(186): a, c, t, g, unknown or other
  misc_feature (159)..(186): n is a, c, g, or t
tcagacgagtgcgtcacgaccggtgctcgatttagtacagatcgttagggaaagggaccaaggtggagatcaaacgaactgtggctgcaccatctgtcttcatcttccagccatctagacncactcgtntgaggcgggtctggacaaggccnctaatgnnnnnnnnnnnnnnnnnnnnnnnnnnnn

SEQ ID NO: 282802 - DNA, 203 bp, Homo sapiens
  misc_feature: GYAE6OF02I2HEV.1.24.C02.1.454.CMB.1.raw
  modified_base (162)..(162): a, c, t, g, unknown or other
  misc_feature (162)..(162): n is a, c, g, or t
  modified_base (164)..(166): a, c, t, g, unknown or other
  misc_feature (164)..(166): n is a, c, g, or t
  modified_base (169)..(203): a, c, t, g, unknown or other
  misc_feature (169)..(203): n is a, c, g, or t
tcagacgagtgcgtcacgaccggtgctcgatttagtacagatcgttagggcaagggaccaaggtggagatcaaacgtaactgtggctgcaccatctgtcttcatcttccgccattctgaattagcgtactctagagcgggactggccaaggcgtcagtaggnannncannnnnnnnnnnnnnnnnnnnnnnnnnnnnnnnnnn

SEQ ID NO: 282803 - DNA, 155 bp, Homo sapiens; identical to SEQ ID NO: 281753
  misc_feature: GYAE6OF02H8S68.1.24.C02.1.454.CMB.1.raw
  modified_base (154)..(155): a, c, t, g, unknown or other
  misc_feature (154)..(155): n is a, c, g, or t

SEQ ID NO: 282804 - DNA, 156 bp, Homo sapiens
  misc_feature: GYAE6OF02H0SAR.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgcactcgtctgagcgggctggcaaggcgcatagnnn

SEQ ID NO: 282805 - DNA, 154 bp, Homo sapiens; identical to SEQ ID NO: 281576
  misc_feature: GYAE6OF02HMB3E.1.24.C02.1.454.CMB.1.raw
  modified_base (154)..(154): a, c, t, g, unknown or other
  misc_feature (154)..(154): n is a, c, g, or t

SEQ ID NO: 282806 - DNA, 158 bp, Homo sapiens
  misc_feature: GYAE6OF02ISRV7.1.24.C02.1.454.CMB.1.raw
  modified_base (150)..(158): a, c, t, g, unknown or other
  misc_feature (150)..(158): n is a, c, g, or t
tcagacgagtgcgtcacgaccggtgctcgatttagtacagatcgttaggcaagggaccaaggtggagatcaaacgaactgtggctgcaccatctgtcttcatcttccgcatctgaatagcgtactctgagcggctggcaaggcgcatagnnnnnnnnn

SEQ ID NO: 282807 - DNA, 156 bp, Homo sapiens
  misc_feature: GYAE6OF02GX7V0.1.24.C02.1.454.CMB.1.raw
  modified_base (128)..(128): a, c, t, g, unknown or other
  misc_feature (128)..(128): n is a, c, g, or t
  modified_base (150)..(156): a, c, t, g, unknown or other
  misc_feature (150)..(156): n is a, c, g, or t
tcagacgagtgcgtcacgaccggtgctcgatttagtacagatcgttaggaagggaccaaggtggagatcaacgaactgtggctgcaccatctgtcttcatcttccgccatctgatatacatcgctgancgggctggcaaggcgcataggnnnnnnn

SEQ ID NO: 282808 - DNA, 155 bp, Homo sapiens; identical to SEQ ID NO: 281575
  misc_feature: GYAE6OF02HCLJQ.1.24.C02.1.454.CMB.1.raw
  modified_base (154)..(155): a, c, t, g, unknown or other
  misc_feature (154)..(155): n is a, c, g, or t

SEQ ID NO: 282809 - DNA, 198 bp, Homo sapiens
  misc_feature: GYAE6OF02HGRFC.1.24.C02.1.454.CMB.1.raw
  modified_base (159)..(198): a, c, t, g, unknown or other
  misc_feature (159)..(198): n is a, c, g, or t
tcagacgagtgcgtcacgaccggtgctcgatttagtacagatcgttagggaaagggtaacgaaggtggagatcaaacgaactgtggctgcaccatctgtcttcgatcttcccgccatctgaacgtctactgctggagcgggctggcaaggcgcatacgnnnnnnnnnnnnnnnnnnnnnnnnnnnnnnnnnnnnnnnn

SEQ ID NO: 282810 - DNA, 154 bp, Homo sapiens; identical to SEQ ID NO: 281904
  misc_feature: GYAE6OF02FWKBI.1.24.C02.1.454.CMB.1.raw
  modified_base (154)..(154): a, c, t, g, unknown or other
  misc_feature (154)..(154): n is a, c, g, or t

SEQ ID NO: 282811 - DNA, 154 bp, Homo sapiens; identical to SEQ ID NO: 281604
  misc_feature: GYAE6OF02GN3LJ.1.24.C02.1.454.CMB.1.raw
  modified_base (154)..(154): a, c, t, g, unknown or other
  misc_feature (154)..(154): n is a, c, g, or t

SEQ ID NO: 282812 - DNA, 154 bp, Homo sapiens; identical to SEQ ID NO: 281604
  misc_feature: GYAE6OF02JB53Q.1.24.C02.1.454.CMB.1.raw
  modified_base (154)..(154): a, c, t, g, unknown or other
  misc_feature (154)..(154): n is a, c, g, or t

SEQ ID NO: 282813 - DNA, 154 bp, Homo sapiens; identical to SEQ ID NO: 281670
  misc_feature: GYAE6OF02H9T1X.1.24.C02.1.454.CMB.1.raw
  modified_base (154)..(154): a, c, t, g, unknown or other
  misc_feature (154)..(154): n is a, c, g, or t

SEQ ID NO: 282814 - DNA, 155 bp, Homo sapiens; identical to SEQ ID NO: 281575
  misc_feature: GYAE6OF02IJ27V.1.24.C02.1.454.CMB.1.raw
  modified_base (154)..(155): a, c, t, g, unknown or other
  misc_feature (154)..(155): n is a, c, g, or t

SEQ ID NO: 282815 - DNA, 154 bp, Homo sapiens; identical to SEQ ID NO: 281576
  misc_feature: GYAE6OF02IZOCV.1.24.C02.1.454.CMB.1.raw
  modified_base (154)..(154): a, c, t, g, unknown or other
  misc_feature (154)..(154): n is a, c, g, or t

SEQ ID NO: 282816 - DNA, 166 bp, Homo sapiens
  misc_feature: GYAE6OF02HDHL2.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggaaagggaccgaaggtggagatcgaaacgaactgtggctgcaccatctgtcttcatcttcccaccctctcacgtagcgtgctgagcgggctggcaaggcgcatagnnnnnnnnnnnn

SEQ ID NO: 282817 - DNA, 178 bp, Homo sapiens
  misc_feature: GYAE6OF02GXRQU.1.24.C02.1.454.CMB.1.raw
  modified_base (156)..(178): a, c, t, g, unknown or other
  misc_feature (156)..(178): n is a, c, g, or t
tcagacgagtgcgtcacgaccggtgctcgatttagtacagatcgttagggaaagggaccaaggtggacgatcaaacgaactgtggcttgcaccatctgtcttcatcttcccgccatctgatcgatcgcgtctgagcgggctggcaaggcgcatagnnnnnnnnnnnnnnnnnnnnnnn

SEQ ID NO: 282818 - DNA, 155 bp, Homo sapiens; identical to SEQ ID NO: 281931
  misc_feature: GYAE6OF02F5M8S.1.24.C02.1.454.CMB.1.raw
  modified_base (154)..(155): a, c, t, g, unknown or other
  misc_feature (154)..(155): n is a, c, g, or t

SEQ ID NO: 282819 - DNA, 154 bp, Homo sapiens; identical to SEQ ID NO: 281670
  misc_feature: GYAE6OF02IHYDK.1.24.C02.1.454.CMB.1.raw
  modified_base (154)..(154): a, c, t, g, unknown or other
  misc_feature (154)..(154): n is a, c, g, or t

SEQ ID NO: 282820 - DNA, 160 bp, Homo sapiens
  misc_feature: GYAE6OF02JUI5E.1.24.C02.1.454.CMB.1.raw
  modified_base (153)..(160): a, c, t, g, unknown or other
  misc_feature (153)..(160): n is a, c, g, or t
tcagacgagtgcgtcacgaccggtgctcgatttagtacagatcgttaggcaagggaccaatgtggagatcaaacgaactgtggctgcaccatctgtcttcatcttcccgccatctgagagtgcgtctctgagcgggctggcaaggcgcatagnnnnnnnn

SEQ ID NO: 282821 - DNA, 154 bp, Homo sapiens; identical to SEQ ID NO: 281552
  misc_feature: GYAE6OF02FYDIO.1.24.C02.1.454.CMB.1.raw
  modified_base (154)..(154): a, c, t, g, unknown or other
  misc_feature (154)..(154): n is a, c, g, or t

SEQ ID NO: 282822 - DNA, 163 bp, Homo sapiens
  misc_feature: GYAE6OF02F8E76.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnnnnnnn

SEQ ID NO: 282823 - DNA, 154 bp, Homo sapiens; identical to SEQ ID NO: 281572
  misc_feature: GYAE6OF02JGR61.1.24.C02.1.454.CMB.1.raw
  modified_base (154)..(154): a, c, t, g, unknown or other
  misc_feature (154)..(154): n is a, c, g, or t

SEQ ID NO: 282824 - DNA, 154 bp, Homo sapiens; identical to SEQ ID NO: 281552
  misc_feature: GYAE6OF02G5QZ9.1.24.C02.1.454.CMB.1.raw
  modified_base (154)..(154): a, c, t, g, unknown or other
  misc_feature (154)..(154): n is a, c, g, or t

SEQ ID NO: 282825 - DNA, 154 bp, Homo sapiens; identical to SEQ ID NO: 281572
  misc_feature: GYAE6OF02GTJM9.1.24.C02.1.454.CMB.1.raw
  modified_base (154)..(154): a, c, t, g, unknown or other
  misc_feature (154)..(154): n is a, c, g, or t

SEQ ID NO: 282826 - DNA, 170 bp, Homo sapiens
  misc_feature: GYAE6OF02GIQDW.1.24.C02.1.454.CMB.1.raw
  modified_base (165)..(170): a, c, t, g, unknown or other
  misc_feature (165)..(170): n is a, c, g, or t
tcagacgagtgcgtcacgaccggtgctcgatttagtacagatcgttagggcaagggaccaaggtggagatcaaacgaactgtggctgcaccatctgtcttcacttcctcccgcatctagaatacgctactctagaggcggtcgtggacgaaggcgactaagtagnnnnnn

SEQ ID NO: 282827 - DNA, 154 bp, Homo sapiens; identical to SEQ ID NO: 281572
  misc_feature: GYAE6OF02F7CEY.1.24.C02.1.454.CMB.1.raw
  modified_base (154)..(154): a, c, t, g, unknown or other
  misc_feature (154)..(154): n is a, c, g, or t

SEQ ID NO: 282828 - DNA, 154 bp, Homo sapiens; identical to SEQ ID NO: 281552
  misc_feature: GYAE6OF02F6SVZ.1.24.C02.1.454.CMB.1.raw
  modified_base (154)..(154): a, c, t, g, unknown or other
  misc_feature (154)..(154): n is a, c, g, or t

SEQ ID NO: 282829 - DNA, 152 bp, Homo sapiens
  misc_feature: GYAE6OF02IQAWX.1.24.C02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagtacagatcgttagggaagggaccaaggtggagatcaaacgaactgtggctgcaccatctgtcttcatcttcccaccctcctcacgcactcgtctgagcggctggcaaggcgcatagn

SEQ ID NO: 282830 - DNA, 157 bp, Homo sapiens; identical to SEQ ID NO: 282630
  misc_feature: GYAE6OF02HE61M.1.24.C02.1.454.CMB.1.raw
  modified_base (154)..(157): a, c, t, g, unknown or other
  misc_feature (154)..(157): n is a, c, g, or t

SEQ ID NO: 282831 - DNA, 155 bp, Homo sapiens
  misc_feature: GYAE6OF02F86AD.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtggagatcaaacgaactgtggctgaactatctgtcttcatcttcccgccatctgaatagcgtactctgagcgggctggcaaggcgcatagnn

SEQ ID NO: 282832 - DNA, 157 bp, Homo sapiens; identical to SEQ ID NO: 281599
  misc_feature: GYAE6OF02JRC96.1.24.C02.1.454.CMB.1.raw
  modified_base (154)..(157): a, c, t, g, unknown or other
  misc_feature (154)..(157): n is a, c, g, or t

SEQ ID NO: 282833 - DNA, 154 bp, Homo sapiens; identical to SEQ ID NO: 281680
  misc_feature: GYAE6OF02GVK16.1.24.C02.1.454.CMB.1.raw
  modified_base (154)..(154): a, c, t, g, unknown or other
  misc_feature (154)..(154): n is a, c, g, or t

SEQ ID NO: 282834 - DNA, 159 bp, Homo sapiens; identical to SEQ ID NO: 281682
  misc_feature: GYAE6OF02HBVHI.1.24.C02.1.454.CMB.1.raw
  modified_base (154)..(159): a, c, t, g, unknown or other
  misc_feature (154)..(159): n is a, c, g, or t

SEQ ID NO: 282835 - DNA, 156 bp, Homo sapiens; identical to SEQ ID NO: 281661
  misc_feature: GYAE6OF02FO6UP.1.24.C02.1.454.CMB.1.raw
  modified_base (154)..(156): a, c, t, g, unknown or other
  misc_feature (154)..(156): n is a, c, g, or t

SEQ ID NO: 282836 - DNA, 180 bp, Homo sapiens
  misc_feature: GYAE6OF02HIIZU.1.24.C02.1.454.CMB.1.raw
  modified_base (161)..(180): a, c, t, g, unknown or other
  misc_feature (161)..(180): n is a, c, g, or t
tcagacgagtgcgtcacgaccggtgctcgatttagtacagatcgttagggcgtaaggggaccaaggtggagattcaaacgaactggtggctgcaccatctgtcttcatcttcccgccatctgaatagcgtactctgagcgggctggacaagggcgcatagnnnnnnnnnnnnnnnnnnnn

SEQ ID NO: 282837 - DNA, 154 bp, Homo sapiens; identical to SEQ ID NO: 281614
  misc_feature: GYAE6OF02JGF7T.1.24.C02.1.454.CMB.1.raw
  modified_base (154)..(154): a, c, t, g, unknown or other
  misc_feature (154)..(154): n is a, c, g, or t

SEQ ID NO: 282838 - DNA, 154 bp, Homo sapiens; identical to SEQ ID NO: 281552
  misc_feature: GYAE6OF02IULCW.1.24.C02.1.454.CMB.1.raw
  modified_base (154)..(154): a, c, t, g, unknown or other
  misc_feature (154)..(154): n is a, c, g, or t

SEQ ID NO: 282839 - DNA, 156 bp, Homo sapiens; identical to SEQ ID NO: 281762
  misc_feature: GYAE6OF02GVCO3.1.24.C02.1.454.CMB.1.raw
  modified_base (154)..(156): a, c, t, g, unknown or other
  misc_feature (154)..(156): n is a, c, g, or t

SEQ ID NO: 282840 - DNA, 155 bp, Homo sapiens; identical to SEQ ID NO: 281555
  misc_feature: GYAE6OF02F8SQT.1.24.C02.1.454.CMB.1.raw
  modified_base (154)..(155): a, c, t, g, unknown or other
  misc_feature (154)..(155): n is a, c, g, or t

SEQ ID NO: 282841 - DNA, 191 bp, Homo sapiens
  misc_feature: GYAE6OF02I74UD.1.24.C02.1.454.CMB.1.raw
  modified_base (133)..(133): a, c, t, g, unknown or other
  misc_feature (133)..(133): n is a, c, g, or t
  modified_base (163)..(165): a, c, t, g, unknown or other
  misc_feature (163)..(165): n is a, c, g, or t
  modified_base (167)..(191): a, c, t, g, unknown or other
  misc_feature (167)..(191): n is a, c, g, or t
tcagacgagtgcgtcacgaccggtgctcgatttagtacagatcgttagggaaagggaccaaggtggagggatcaaacgtaacgtgtggctgcaccagtctgtcttcatcttccgccatctgatcgtactgccnctgagcgggctggacaaggcgcgtatggcnnncnnnnnnnnnnnnnnnnnnnnnnnnn

SEQ ID NO: 282842 - DNA, 170 bp, Homo sapiens; identical to SEQ ID NO: 282484
  misc_feature: GYAE6OF02JI8LH.1.24.C02.1.454.CMB.1.raw
  modified_base (154)..(170): a, c, t, g, unknown or other
  misc_feature (154)..(170): n is a, c, g, or t

SEQ ID NO: 282843 - DNA, 154 bp, Homo sapiens; identical to SEQ ID NO: 281552
  misc_feature: GYAE6OF02IMU9D.1.24.C02.1.454.CMB.1.raw
  modified_base (154)..(154): a, c, t, g, unknown or other
  misc_feature (154)..(154): n is a, c, g, or t

SEQ ID NO: 282844 - DNA, 153 bp, Homo sapiens; identical to SEQ ID NO: 282385
  misc_feature: GYAE6OF02F9G2N.1.24.C02.1.454.CMB.1.raw

SEQ ID NO: 282845 - DNA, 155 bp, Homo sapiens; identical to SEQ ID NO: 282509
  misc_feature: GYAE6OF02FYKG6.1.24.C02.1.454.CMB.1.raw
  modified_base (153)..(155): a, c, t, g, unknown or other
  misc_feature (153)..(155): n is a, c, g, or t

SEQ ID NO: 282846 - DNA, 154 bp, Homo sapiens; identical to SEQ ID NO: 281644
  misc_feature: GYAE6OF02GOMJV.1.24.C02.1.454.CMB.1.raw
  modified_base (154)..(154): a, c, t, g, unknown or other
  misc_feature (154)..(154): n is a, c, g, or t

SEQ ID NO: 282847 - DNA, 155 bp, Homo sapiens; identical to SEQ ID NO: 281799
  misc_feature: GYAE6OF02HZCCZ.1.24.C02.1.454.CMB.1.raw
  modified_base (154)..(155): a, c, t, g, unknown or other
  misc_feature (154)..(155): n is a, c, g, or t

SEQ ID NO: 282848 - DNA, 155 bp, Homo sapiens; identical to SEQ ID NO: 281555
  misc_feature: GYAE6OF02JG5EI.1.24.C02.1.454.CMB.1.raw
  modified_base (154)..(155): a, c, t, g, unknown or other
  misc_feature (154)..(155): n is a, c, g, or t

SEQ ID NO: 282849 - DNA, 153 bp, Homo sapiens
  misc_feature: GYAE6OF02GYRFR.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccacctcctcacgtagcgtgctgagcgggctggcaaggcgcatagn

SEQ ID NO: 282850 - DNA, 170 bp, Homo sapiens
  misc_feature: GYAE6OF02IDASI.1.24.C02.1.454.CMB.1.raw
  modified_base (155)..(170): a, c, t, g, unknown or other
  misc_feature (155)..(170): n is a, c, g, or t
tcagacgagtgcgtcacgaccggtgctcgatttagtacagatcgttagggaaagggaccaaggtggagatcaaacgaactgtggctgcaccatctgtcttcatcttcccacactcctcacgcactcgtctgagcgggctggcaaggtcgcatagnnnnnnnnnnnnnnnn

SEQ ID NO: 282851 - DNA, 154 bp, Homo sapiens; identical to SEQ ID NO: 281552
  misc_feature: GYAE6OF02GZIFF.1.24.C02.1.454.CMB.1.raw
  modified_base (154)..(154): a, c, t, g, unknown or other
  misc_feature (154)..(154): n is a, c, g, or t

SEQ ID NO: 282852 - DNA, 155 bp, Homo sapiens
  misc_feature: GYAE6OF02G38R4.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggcaagggaccaaggtgtagatcaaacgaactgtggctgcaccatctgtcttcatcttcctgccatctgaatagcgtactctgagcgggctggcaaggcgcatagnn

SEQ ID NO: 282853 - DNA, 195 bp, Homo sapiens
  misc_feature: GYAE6OF02HX6J2.1.24.C02.1.454.CMB.1.raw
  modified_base (159)..(195): a, c, t, g, unknown or other
  misc_feature (159)..(195): n is a, c, g, or t
tcagacgagtgcgtcacgaccggtgctcgatttagtacagatcgttaggtggcaagggaccaaggtggagagtcaaacgaactgtggctgcaccatctgtcttcatcttcccgccaatctgactcgtctctactgagcgggctggcaagggcgcatagnnnnnnnnnnnnnnnnnnnnnnnnnnnnnnnnnnnnn

SEQ ID NO: 282854 - DNA, 156 bp, Homo sapiens
  misc_feature: GYAE6OF02HJUBU.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtagcgtgctgagcgggctggcaaggcgcatagnnn

SEQ ID NO: 282855 - DNA, 154 bp, Homo sapiens
  misc_feature: GYAE6OF02FZEPS.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagagtactctgagcgggctggcaaggcgcatagn

SEQ ID NO: 282856 - DNA, 164 bp, Homo sapiens
  misc_feature: GYAE6OF02GEOUL.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnnnnnnnnnn

SEQ ID NO: 282857 - DNA, 155 bp, Homo sapiens; identical to SEQ ID NO: 281555
  misc_feature: GYAE6OF02GB8PQ.1.24.C02.1.454.CMB.1.raw
  modified_base (154)..(155): a, c, t, g, unknown or other
  misc_feature (154)..(155): n is a, c, g, or t

SEQ ID NO: 282858 - DNA, 154 bp, Homo sapiens; identical to SEQ ID NO: 281552
  misc_feature: GYAE6OF02JAPBJ.1.24.C02.1.454.CMB.1.raw
  modified_base (154)..(154): a, c, t, g, unknown or other
  misc_feature (154)..(154): n is a, c, g, or t

SEQ ID NO: 282859 - DNA, 155 bp, Homo sapiens; identical to SEQ ID NO: 281555
  misc_feature: GYAE6OF02INFU7.1.24.C02.1.454.CMB.1.raw
  modified_base (154)..(155): a, c, t, g, unknown or other
  misc_feature (154)..(155): n is a, c, g, or t

SEQ ID NO: 282860 - DNA, 165 bp, Homo sapiens
  misc_feature: GYAE6OF02HDQPG.1.24.C02.1.454.CMB.1.raw
  modified_base (155)..(165): a, c, t, g, unknown or other
  misc_feature (155)..(165): n is a, c, g, or t
tcagacgagtgcgtcacgaccggtgctcgatttagtacagatcgttagggaaaggggaccaaggtggagatcaaacgaactgtggctgcaccatctgtcttcatcttcccgccatctgaatagcgtactctgagcgggctggcaaggcgcatagnnnnnnnnnnn

SEQ ID NO: 282861 - DNA, 154 bp, Homo sapiens
  misc_feature: GYAE6OF02GK6Z0.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtagcgtgctgagcgggctggcaaggcgcatagn

SEQ ID NO: 282862 - DNA, 154 bp, Homo sapiens; identical to SEQ ID NO: 281604
  misc_feature: GYAE6OF02F69E7.1.24.C02.1.454.CMB.1.raw
  modified_base (154)..(154): a, c, t, g, unknown or other
  misc_feature (154)..(154): n is a, c, g, or t

SEQ ID NO: 282863 - DNA, 164 bp, Homo sapiens; identical to SEQ ID NO: 281630
  misc_feature: GYAE6OF02HVT3E.1.24.C02.1.454.CMB.1.raw
  modified_base (154)..(164): a, c, t, g, unknown or other
  misc_feature (154)..(164): n is a, c, g, or t

SEQ ID NO: 282864 - DNA, 180 bp, Homo sapiens
  misc_feature: GYAE6OF02HM9OV.1.24.C02.1.454.CMB.1.raw
  modified_base (155)..(180): a, c, t, g, unknown or other
  misc_feature (155)..(180): n is a, c, g, or t
tcagacgagtgcgtcacgaccggtgctcgatttagtacagatcgttagggcaagggaccaaggtggagatcgaaacgaactgtggctgcaccatctgtcttcatcttcccgccatctgaatagcgtactctgagcgggctggcaaggcgcatagnnnnnnnnnnnnnnnnnnnnnnnnnn

SEQ ID NO: 282865 - DNA, 157 bp, Homo sapiens
  misc_feature: GYAE6OF02G6IVX.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnn

SEQ ID NO: 282866 - DNA, 155 bp, Homo sapiens; identical to SEQ ID NO: 281799
  misc_feature: GYAE6OF02HKEJ0.1.24.C02.1.454.CMB.1.raw
  modified_base (154)..(155): a, c, t, g, unknown or other
  misc_feature (154)..(155): n is a, c, g, or t

SEQ ID NO: 282867 - DNA, 156 bp, Homo sapiens; identical to SEQ ID NO: 281661
  misc_feature: GYAE6OF02G0IZR.1.24.C02.1.454.CMB.1.raw
  modified_base (154)..(156): a, c, t, g, unknown or other
  misc_feature (154)..(156): n is a, c, g, or t

SEQ ID NO: 282868 - DNA, 168 bp, Homo sapiens
  misc_feature: GYAE6OF02G588Q.1.24.C02.1.454.CMB.1.raw
  modified_base (154)..(168): a, c, t, g, unknown or other
  misc_feature (154)..(168): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcgggctggcaaggcgcatagnnnnnnnnnnnnnnn

SEQ ID NO: 282869 - DNA, 613 bp, Homo sapiens
  misc_feature: GYAE6OF02GELOK.1.24.C02.1.454.CMB.1.raw
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (189)..(190): a, c, t, g, unknown or other
  misc_feature (189)..(190): n is a, c, g, or t
  modified_base (200)..(205): a, c, t, g, unknown or other
  misc_feature (200)..(205): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (262)..(263): a, c, t, g, unknown or other
  misc_feature (262)..(263): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
tcagacgagtgcgtcacgaccggtgctcgattttagtacagatcgttagggcgaaaggggaccaaggtcgggagatcaaacgtaactgtggctgcaccgaaggtcttgtcttcatcttccgcgatctgaatagcgtactactaagagacggggctcggcaagggtcgtccactaggcngngcgctcagnnggctgccagnnnnnncngngcgcagngngngacgcgtcgcgctctcctcncncncnctctctcgtgtgctcnncngcngacacgtacttacgtcgtcggtcgtacgacgccgccgaccgacccggacgggacggtcggtcggtaggtacggtaggtaggtagttacgttacgtacgtaggtacggacgactacctacgtaccgtaacccgtaccgtaacgtaacgtacgacgacgaactactacgtacgtacgaacgtaccgaaccgaacgtaacctaacttacctaccgtacgtacgtacgtacgtacgtaccgttcgtcgtacgaccgccgacgaccgacgacgtacgttacgttacgttacgttacgtacgtacggtaccggaccggaccggcggcgtcgtacggtcgtttcgttgtacg

SEQ ID NO: 282870 - DNA, 228 bp, Homo sapiens
  misc_feature: GYAE6OF02FLI67.1.24.C02.1.454.CMB.1.raw
  modified_base (172)..(228): a, c, t, g, unknown or other
  misc_feature (172)..(228): n is a, c, g, or t
tcagacgagtgcgtcacgaccggtgctcgatttagtacagatcgttagggaaagggtaccgaaggtgggagatcaaaccgaactgtgggctgcaccatcgtgtcttcagtccttcccgccaatccttgagtatcgtatacctctgagcggggctcggcaaggccgacatagnnnnnnnnnnnnnnnnnnnnnnnnnnnnnnnnnnnnnnnnnnnnnnnnnnnnnnnnn

SEQ ID NO: 282871 - DNA, 157 bp, Homo sapiens; identical to SEQ ID NO: 281599
  misc_feature: GYAE6OF02IK5FJ.1.24.C02.1.454.CMB.1.raw
  modified_base (154)..(157): a, c, t, g, unknown or other
  misc_feature (154)..(157): n is a, c, g, or t

SEQ ID NO: 282872 - DNA, 163 bp, Homo sapiens; identical to SEQ ID NO: 282520
  misc_feature: GYAE6OF02FX4HG.1.24.C02.1.454.CMB.1.raw
  modified_base (154)..(163): a, c, t, g, unknown or other
  misc_feature (154)..(163): n is a, c, g, or t

SEQ ID NO: 282873 - DNA, 154 bp, Homo sapiens
  misc_feature: GYAE6OF02HFHM0.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgtctactgctgagcgggctggcaaggcgcatagn

SEQ ID NO: 282874 - DNA, 154 bp, Homo sapiens; identical to SEQ ID NO: 281552
  misc_feature: GYAE6OF02HJWID.1.24.C02.1.454.CMB.1.raw
  modified_base (154)..(154): a, c, t, g, unknown or other
  misc_feature (154)..(154): n is a, c, g, or t

SEQ ID NO: 282875 - DNA, 153 bp, Homo sapiens
  misc_feature: GYAE6OF02I260S.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgactcgtcttactgagcgggctggcaaggcgcatagn

SEQ ID NO: 282876 - DNA, 155 bp, Homo sapiens; identical to SEQ ID NO: 282704
  misc_feature: GYAE6OF02HDQ03.1.24.C02.1.454.CMB.1.raw
  modified_base (154)..(155): a, c, t, g, unknown or other
  misc_feature (154)..(155): n is a, c, g, or t

SEQ ID NO: 282877 - DNA, 155 bp, Homo sapiens; identical to SEQ ID NO: 281876
  misc_feature: GYAE6OF02G10SU.1.24.C02.1.454.CMB.1.raw
  modified_base (154)..(155): a, c, t, g, unknown or other
  misc_feature (154)..(155): n is a, c, g, or t

SEQ ID NO: 282878 - DNA, 154 bp, Homo sapiens; identical to SEQ ID NO: 281681
  misc_feature: GYAE6OF02FPJOU.1.24.C02.1.454.CMB.1.raw
  modified_base (154)..(154): a, c, t, g, unknown or other
  misc_feature (154)..(154): n is a, c, g, or t

SEQ ID NO: 282879 - DNA, 154 bp, Homo sapiens; identical to SEQ ID NO: 281604
  misc_feature: GYAE6OF02FG0XP.1.24.C02.1.454.CMB.1.raw
  modified_base (154)..(154): a, c, t, g, unknown or other
  misc_feature (154)..(154): n is a, c, g, or t

SEQ ID NO: 282880 - DNA, 157 bp, Homo sapiens
  misc_feature: GYAE6OF02HQ66W.1.24.C02.1.454.CMB.1.raw
  modified_base (153)..(157): a, c, t, g, unknown or other
  misc_feature (153)..(157): n is a, c, g, or t
tcagacgagtgcgtcacgaccggtgctcgatttagtacagatcgttagtgcaagggaccaaggtggagatcaaacgaactgtggctgcaccatctgtcttcatcttccgccatctgactcgtctctactgagcgggctggcaaggcgcatagnnnnn

SEQ ID NO: 282881 - DNA, 154 bp, Homo sapiens; identical to SEQ ID NO: 281604
  misc_feature: GYAE6OF02FQBW7.1.24.C02.1.454.CMB.1.raw
  modified_base (154)..(154): a, c, t, g, unknown or other
  misc_feature (154)..(154): n is a, c, g, or t

SEQ ID NO: 282882 - DNA, 154 bp, Homo sapiens; identical to SEQ ID NO: 281552
  misc_feature: GYAE6OF02GZ1UM.1.24.C02.1.454.CMB.1.raw
  modified_base (154)..(154): a, c, t, g, unknown or other
  misc_feature (154)..(154): n is a, c, g, or t

SEQ ID NO: 282883 - DNA, 289 bp, Homo sapiens
  misc_feature: GYAE6OF02IFWKM.1.24.C02.1.454.CMB.1.raw
  modified_base (286)..(289): a, c, t, g, unknown or other
  misc_feature (286)..(289): n is a, c, g, or t
tcagacgagtgcgtcacgaccggtgctcgatttagtacagatcgttcgagggaatccgggtccctgaccgattcagtggcagcgggtctgggacagatttcactctcaccatcagcagcctgcagcctgaagattttgcaacttattactgtcaacagcttaatagttacccttacacttttggccaggggaccaagctggagatcaaacgaactgtggctgcaccatctgtcttcatcttccgcatctgaacgcactcgtctgagcggctggcaaggcgcatagnnnn

SEQ ID NO: 282884 - DNA, 146 bp, Homo sapiens
  misc_feature: GYAE6OF02FL6WU.1.24.C02.1.454.CMB.1.raw
  modified_base (125)..(125): a, c, t, g, unknown or other
  misc_feature (125)..(125): n is a, c, g, or t
  modified_base (146)..(146): a, c, t, g, unknown or other
  misc_feature (146)..(146): n is a, c, g, or t
tcagacgagtgcgtcacgaccggtgctcgattagtacagatcgttaggaaggaccaaggtgagatcaaacgaactgtgctgcaccatctgtcttcatcttcccgccatctgaatagcgtactctnagcgggctgcaagcgcatagn

SEQ ID NO: 282885 - DNA, 154 bp, Homo sapiens; identical to SEQ ID NO: 281576
  misc_feature: GYAE6OF02G7ZQS.1.24.C02.1.454.CMB.1.raw
  modified_base (154)..(154): a, c, t, g, unknown or other
  misc_feature (154)..(154): n is a, c, g, or t

SEQ ID NO: 282886 - DNA, 156 bp, Homo sapiens; identical to SEQ ID NO: 281661
  misc_feature: GYAE6OF02FLW8P.1.24.C02.1.454.CMB.1.raw
  modified_base (154)..(156): a, c, t, g, unknown or other
  misc_feature (154)..(156): n is a, c, g, or t

SEQ ID NO: 282887 - DNA, 154 bp, Homo sapiens; identical to SEQ ID NO: 281681
  misc_feature: GYAE6OF02IOUM1.1.24.C02.1.454.CMB.1.raw
  modified_base (154)..(154): a, c, t, g, unknown or other
  misc_feature (154)..(154): n is a, c, g, or t

SEQ ID NO: 282888 - DNA, 156 bp, Homo sapiens
  misc_feature: GYAE6OF02HQBPE.1.24.C02.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnn

SEQ ID NO: 282889 - DNA, 154 bp, Homo sapiens; identical to SEQ ID NO: 281644
  misc_feature: GYAE6OF02IK0Q9.1.24.C02.1.454.CMB.1.raw
  modified_base (154)..(154): a, c, t, g, unknown or other
  misc_feature (154)..(154): n is a, c, g, or t

SEQ ID NO: 282890 - DNA, 157 bp, Homo sapiens
  misc_feature: GYAE6OF02GBTLS.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggcaagggaccaaggtggagatcaaacgaactgtgtctgcaccatctgtcttcatcttcccgccatctgaatagcgtactctgagcgggctggcaaggcgcatagnnnn

SEQ ID NO: 282891 - DNA, 155 bp, Homo sapiens; identical to SEQ ID NO: 281555
  misc_feature: GYAE6OF02FUIYT.1.24.C02.1.454.CMB.1.raw
  modified_base (154)..(155): a, c, t, g, unknown or other
  misc_feature (154)..(155): n is a, c, g, or t

SEQ ID NO: 282892 - DNA, 160 bp, Homo sapiens
  misc_feature: GYAE6OF02FGVNZ.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagnnnnnnn

SEQ ID NO: 282893 - DNA, 154 bp, Homo sapiens; identical to SEQ ID NO: 281569
  misc_feature: GYAE6OF02FT31B.1.24.C02.1.454.CMB.1.raw
  modified_base (154)..(154): a, c, t, g, unknown or other
  misc_feature (154)..(154): n is a, c, g, or t

SEQ ID NO: 282894 - DNA, 173 bp, Homo sapiens
  misc_feature: GYAE6OF02F6V9C.1.24.C02.1.454.CMB.1.raw
  modified_base (156)..(173): a, c, t, g, unknown or other
  misc_feature (156)..(173): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaagtcgctagactgagcggggctgggcaaggcgcatagnnnnnnnnnnnnnnnnnn

SEQ ID NO: 282895 - DNA, 153 bp, Homo sapiens; identical to SEQ ID NO: 282226
  misc_feature: GYAE6OF02FL348.1.24.C02.1.454.CMB.1.raw

SEQ ID NO: 282896 - DNA, 154 bp, Homo sapiens; identical to SEQ ID NO: 281607
  misc_feature: GYAE6OF02FROCV.1.24.C02.1.454.CMB.1.raw
  modified_base (154)..(154): a, c, t, g, unknown or other
  misc_feature (154)..(154): n is a, c, g, or t

SEQ ID NO: 282897 - DNA, 174 bp, Homo sapiens
  misc_feature: GYAE6OF02F0O3B.1.24.C02.1.454.CMB.1.raw
  modified_base (155)..(174): a, c, t, g, unknown or other
  misc_feature (155)..(174): n is a, c, g, or t
tcagacgagtgcgtcacgaccggtgctcgatttagtacagatcgttagggcaagggaccaaggtgtagatcaaacgaactgtggcctgcaccatctgtcttcatcttcccgccatctgaatagcgtactctgagcgggctggcaaggcgcatagnnnnnnnnnnnnnnnnnnnn

SEQ ID NO: 282898 - DNA, 294 bp, Homo sapiens
  misc_feature: GYAE6OF02HUDMP.1.24.C02.1.454.CMB.1.raw
  modified_base (289)..(294): a, c, t, g, unknown or other
  misc_feature (289)..(294): n is a, c, g, or t
tcagacgagtgcgtcacgaccggtgctcgatttagtacagatcgttcgcgggaatccggggtccctgaccgattcagtggcagcgggtctgggacagatttcactctcaccatcagcagcctgcagcctgaagattttgcaacttattactgtcaacagcttaatagttacccttacacttttggccaggggaccaagctggagatcaaacgaactgtggctgcaccatctgtcttcatcttccgccatctgaacgcactcgtctgagcgggctggcaaggcgcatagnnnnnn

SEQ ID NO: 282899 - DNA, 160 bp, Homo sapiens; identical to SEQ ID NO: 282495
  misc_feature: GYAE6OF02H2ZNV.1.24.C02.1.454.CMB.1.raw
  modified_base (155)..(160): a, c, t, g, unknown or other
  misc_feature (155)..(160): n is a, c, g, or t

SEQ ID NO: 282900 - DNA, 162 bp, Homo sapiens; identical to SEQ ID NO: 282515
  misc_feature: GYAE6OF02GIPZW.1.24.C02.1.454.CMB.1.raw
  modified_base (154)..(162): a, c, t, g, unknown or other
  misc_feature (154)..(162): n is a, c, g, or t

SEQ ID NO: 282901 - DNA, 161 bp, Homo sapiens
  misc_feature: GYAE6OF02IJ6U2.1.24.C02.1.454.CMB.1.raw
  modified_base (154)..(161): a, c, t, g, unknown or other
  misc_feature (154)..(161): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnnnnnn

SEQ ID NO: 282902 - DNA, 155 bp, Homo sapiens; identical to SEQ ID NO: 281555
  misc_feature: GYAE6OF02FSZMQ.1.24.C02.1.454.CMB.1.raw
  modified_base (154)..(155): a, c, t, g, unknown or other
  misc_feature (154)..(155): n is a, c, g, or t

SEQ ID NO: 282903 - DNA, 154 bp, Homo sapiens; identical to SEQ ID NO: 281681
  misc_feature: GYAE6OF02IMOKO.1.24.C02.1.454.CMB.1.raw
  modified_base (154)..(154): a, c, t, g, unknown or other
  misc_feature (154)..(154): n is a, c, g, or t

SEQ ID NO: 282904 - DNA, 155 bp, Homo sapiens; identical to SEQ ID NO: 281753
  misc_feature: GYAE6OF02FMB7L.1.24.C02.1.454.CMB.1.raw
  modified_base (154)..(155): a, c, t, g, unknown or other
  misc_feature (154)..(155): n is a, c, g, or t

SEQ ID NO: 282905 - DNA, 166 bp, Homo sapiens
  misc_feature: GYAE6OF02HCFRT.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggaaagtgaccgaaggtggagatcaaactaactgtggctgcaccatctgtcttcatcttcccgccatctgatcgtactgcgctgagcgggctggcaaggcgcatagnnnnnnnnnnnn

SEQ ID NO: 282906 - DNA, 156 bp, Homo sapiens; identical to SEQ ID NO: 281661
  misc_feature: GYAE6OF02G47GU.1.24.C02.1.454.CMB.1.raw
  modified_base (154)..(156): a, c, t, g, unknown or other
  misc_feature (154)..(156): n is a, c, g, or t

SEQ ID NO: 282907 - DNA, 155 bp, Homo sapiens; identical to SEQ ID NO: 281978
  misc_feature: GYAE6OF02I5JH4.1.24.C02.1.454.CMB.1.raw
  modified_base (154)..(155): a, c, t, g, unknown or other
  misc_feature (154)..(155): n is a, c, g, or t

SEQ ID NO: 282908 - DNA, 159 bp, Homo sapiens; identical to SEQ ID NO: 282758
  misc_feature: GYAE6OF02INJCU.1.24.C02.1.454.CMB.1.raw
  modified_base (154)..(159): a, c, t, g, unknown or other
  misc_feature (154)..(159): n is a, c, g, or t

SEQ ID NO: 282909 - DNA, 157 bp, Homo sapiens; identical to SEQ ID NO: 281599
  misc_feature: GYAE6OF02F9DCX.1.24.C02.1.454.CMB.1.raw
  modified_base (154)..(157): a, c, t, g, unknown or other
  misc_feature (154)..(157): n is a, c, g, or t

SEQ ID NO: 282910 - DNA, 180 bp, Homo sapiens
  misc_feature: GYAE6OF02FF9XT.1.24.C02.1.454.CMB.1.raw
  modified_base (155)..(180): a, c, t, g, unknown or other
  misc_feature (155)..(180): n is a, c, g, or t
tcagacgagtgcgtcacgaccggtgctcgatttagtacagatcgttagggaaagggaccaaggtggagaatcaaacgaactgtggctgcaccatctgtcttcatcttcccgccatctgaacgcactcgtctgagcgggctggcaaggcgcatagnnnnnnnnnnnnnnnnnnnnnnnnnn

SEQ ID NO: 282911 - DNA, 172 bp, Homo sapiens
  misc_feature: GYAE6OF02GPUFT.1.24.C02.1.454.CMB.1.raw
  modified_base (153)..(172): a, c, t, g, unknown or other
  misc_feature (153)..(172): n is a, c, g, or t
tcagacgagtgcgtcacgaccggtgctcgatttagtacagatcgttagggaagtgaccaaggtggagatcaaactaactgtggctgcaccatctgtcttcatcttcccgccatctgatcgtactgcgctgagcgggctggcaaggcgcatagnnnnnnnnnnnnnnnnnnnn

SEQ ID NO: 282912 - DNA, 162 bp, Homo sapiens
  misc_feature: GYAE6OF02H86BF.1.24.C02.1.454.CMB.1.raw
  modified_base (153)..(162): a, c, t, g, unknown or other
  misc_feature (153)..(162): n is a, c, g, or t
tcagacgagtgcgtcacgaccggtgctcgatttagtacagatcgttagggcgaagggaccaaggtggagatcaaacgaactgtggctgcaccatctgtcttcatcttccgcatctgaatagcgtactctgagcgggctggcaaggcgcatagnnnnnnnnnn

SEQ ID NO: 282913 - DNA, 154 bp, Homo sapiens; identical to SEQ ID NO: 281552
  misc_feature: GYAE6OF02I37L5.1.24.C02.1.454.CMB.1.raw
  modified_base (154)..(154): a, c, t, g, unknown or other
  misc_feature (154)..(154): n is a, c, g, or t

SEQ ID NO: 282914 - DNA, 155 bp, Homo sapiens; identical to SEQ ID NO: 281799
  misc_feature: GYAE6OF02IZ0CF.1.24.C02.1.454.CMB.1.raw
  modified_base (154)..(155): a, c, t, g, unknown or other
  misc_feature (154)..(155): n is a, c, g, or t

SEQ ID NO: 282915 - DNA, 154 bp, Homo sapiens; identical to SEQ ID NO: 281614
  misc_feature: GYAE6OF02FOZ2G.1.24.C02.1.454.CMB.1.raw
  modified_base (154)..(154): a, c, t, g, unknown or other
  misc_feature (154)..(154): n is a, c, g, or t

SEQ ID NO: 282916 - DNA, 154 bp, Homo sapiens; identical to SEQ ID NO: 281572
  misc_feature: GYAE6OF02FEUA0.1.24.C02.1.454.CMB.1.raw
  modified_base (154)..(154): a, c, t, g, unknown or other
  misc_feature (154)..(154): n is a, c, g, or t

SEQ ID NO: 282917 - DNA, 155 bp, Homo sapiens; identical to SEQ ID NO: 281675
  misc_feature: GYAE6OF02FQMZV.1.24.C02.1.454.CMB.1.raw
  modified_base (154)..(155): a, c, t, g, unknown or other
  misc_feature (154)..(155): n is a, c, g, or t

SEQ ID NO: 282918 - DNA, 212 bp, Homo sapiens
  misc_feature: GYAE6OF02F1B9V.1.24.C02.1.454.CMB.1.raw
  modified_base (159)..(163): a, c, t, g, unknown or other
  misc_feature (159)..(163): n is a, c, g, or t
  modified_base (165)..(212): a, c, t, g, unknown or other
  misc_feature (165)..(212): n is a, c, g, or t
tcagacgagtgcgtcacgaccggtgctcgatttagtacagatcgttagggaaagggtaccaaggtggagatcaaacgaactgtggcctgcaccatcttgtcttcatcttcccgccctcctcacgcactcgtctgagcgggctggcaaggcgcataggtnnnnntnnnnnnnnnnnnnnnnnnnnnnnnnnnnnnnnnnnnnnnnnnnnnnnn

SEQ ID NO: 282919 - DNA, 155 bp, Homo sapiens; identical to SEQ ID NO: 281799
  misc_feature: GYAE6OF02HJFEE.1.24.C02.1.454.CMB.1.raw
  modified_base (154)..(155): a, c, t, g, unknown or other
  misc_feature (154)..(155): n is a, c, g, or t

SEQ ID NO: 282920 - DNA, 154 bp, Homo sapiens; identical to SEQ ID NO: 281552
  misc_feature: GYAE6OF02HNVH9.1.24.C02.1.454.CMB.1.raw
  modified_base (154)..(154): a, c, t, g, unknown or other
  misc_feature (154)..(154): n is a, c, g, or t

SEQ ID NO: 282921 - DNA, 154 bp, Homo sapiens; identical to SEQ ID NO: 281604
  misc_feature: GYAE6OF02GBNE7.1.24.C02.1.454.CMB.1.raw
  modified_base (154)..(154): a, c, t, g, unknown or other
  misc_feature (154)..(154): n is a, c, g, or t

SEQ ID NO: 282922 - DNA, 154 bp, Homo sapiens; identical to SEQ ID NO: 281552
  misc_feature: GYAE6OF02HJW9X.1.24.C02.1.454.CMB.1.raw
  modified_base (154)..(154): a, c, t, g, unknown or other
  misc_feature (154)..(154): n is a, c, g, or t

SEQ ID NO: 282923 - DNA, 156 bp, Homo sapiens; identical to SEQ ID NO: 281661
  misc_feature: GYAE6OF02JXX47.1.24.C02.1.454.CMB.1.raw
  modified_base (154)..(156): a, c, t, g, unknown or other
  misc_feature (154)..(156): n is a, c, g, or t

SEQ ID NO: 282924 - DNA, 153 bp, Homo sapiens; identical to SEQ ID NO: 282226
  misc_feature: GYAE6OF02IJPNQ.1.24.C02.1.454.CMB.1.raw

SEQ ID NO: 282925 - DNA, 155 bp, Homo sapiens; identical to SEQ ID NO: 281697
  misc_feature: GYAE6OF02HN8RP.1.24.C02.1.454.CMB.1.raw
  modified_base (154)..(155): a, c, t, g, unknown or other
  misc_feature (154)..(155): n is a, c, g, or t

SEQ ID NO: 282926 - DNA, 154 bp, Homo sapiens; identical to SEQ ID NO: 281670
  misc_feature: GYAE6OF02GU9GS.1.24.C02.1.454.CMB.1.raw
  modified_base (154)..(154): a, c, t, g, unknown or other
  misc_feature (154)..(154): n is a, c, g, or t

SEQ ID NO: 282927 - DNA, 180 bp, Homo sapiens
  misc_feature: GYAE6OF02I4XCC.1.24.C02.1.454.CMB.1.raw
  modified_base (155)..(180): a, c, t, g, unknown or other
  misc_feature (155)..(180): n is a, c, g, or t
tcagacgagtgcgtcacgaccggtgctcgatttagtacagatcgttaggggcaagggaccaaggtggagatcaaacgaactgtggctgcaccatctgtcttcatcttcccgccatctgaatagcgtactctgagcgggctggcaaggcgcatagnnnnnnnnnnnnnnnnnnnnnnnnnn

SEQ ID NO: 282928 - DNA, 159 bp, Homo sapiens
  misc_feature: GYAE6OF02GTIDC.1.24.C02.1.454.CMB.1.raw
  modified_base (155)..(159): a, c, t, g, unknown or other
  misc_feature (155)..(159): n is a, c, g, or t
tcagacgagtgcgtcacgaccggtgctcgatttagtacagatcgttagggcaagggaccaaggtgtagatcaaacgaactgtggctgcaccatctgtcttcatctttcccgccatctgaatagcgtactctgagcgggctggcaaggcgcatagnnnnn

SEQ ID NO: 282929 - DNA, 165 bp, Homo sapiens
  misc_feature: GYAE6OF02GP2TO.1.24.C02.1.454.CMB.1.raw
  modified_base (128)..(128): a, c, t, g, unknown or other
  misc_feature (128)..(128): n is a, c, g, or t
  modified_base (158)..(165): a, c, t, g, unknown or other
  misc_feature (158)..(165): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctagatagctactngaggcggtcgtgacgaaggcgactagtagnnnnnnnn

SEQ ID NO: 282930 - DNA, 156 bp, Homo sapiens; identical to SEQ ID NO: 281661
  misc_feature: GYAE6OF02GY8M6.1.24.C02.1.454.CMB.1.raw
  modified_base (154)..(156): a, c, t, g, unknown or other
  misc_feature (154)..(156): n is a, c, g, or t

SEQ ID NO: 282931 - DNA, 174 bp, Homo sapiens
  misc_feature: GYAE6OF02FQE24.1.24.C02.1.454.CMB.1.raw
  modified_base (156)..(174): a, c, t, g, unknown or other
  misc_feature (156)..(174): n is a, c, g, or t
tcagacgagtgcgtcacgaccggtgctcgatttagtacagatcgttagggaaagggaccaaggtggagaatcaaaccgaactgtggctcgcaccatctgtcttcatcttcccgcatctgaatagcgtactctgagcgggctggcaaggcgcatagnnnnnnnnnnnnnnnnnnn

SEQ ID NO: 282932 - DNA, 154 bp, Homo sapiens; identical to SEQ ID NO: 281552
  misc_feature: GYAE6OF02GZJAO.1.24.C02.1.454.CMB.1.raw
  modified_base (154)..(154): a, c, t, g, unknown or other
  misc_feature (154)..(154): n is a, c, g, or t

SEQ ID NO: 282933 - DNA, 178 bp, Homo sapiens
  misc_feature: GYAE6OF02FINZT.1.24.C02.1.454.CMB.1.raw
  modified_base (155)..(178): a, c, t, g, unknown or other
  misc_feature (155)..(178): n is a, c, g, or t
tcagacgagtgcgtcacgaccggtgctcgatttagtacagatcgttagggcgaagggaccaaggtgtagatcaaacgaactgtggctgcaccatctgtcttcatcttcccgccatctgaatagcgtactctgagcgggctggcaaggcgcatagnnnnnnnnnnnnnnnnnnnnnnnn

SEQ ID NO: 282934 - DNA, 155 bp, Homo sapiens; identical to SEQ ID NO: 281799
  misc_feature: GYAE6OF02FM9YB.1.24.C02.1.454.CMB.1.raw
  modified_base (154)..(155): a, c, t, g, unknown or other
  misc_feature (154)..(155): n is a, c, g, or t

SEQ ID NO: 282935 - DNA, 185 bp, Homo sapiens
  misc_feature: GYAE6OF02HMZSF.1.24.C02.1.454.CMB.1.raw
  modified_base (161)..(185): a, c, t, g, unknown or other
  misc_feature (161)..(185): n is a, c, g, or t
tcagacgagtgcgtcacgaccggtgctcgatttagtacagatcgttagggcaaggggacccaaaggtggacgatcgaaacgaactcgtggctgcaccatctgtcttcatcttcccgccatctgaatagtcgtactctgagcgggctggcaaggcgcatagnnnnnnnnnnnnnnnnnnnnnnnnn

SEQ ID NO: 282936 - DNA, 154 bp, Homo sapiens; identical to SEQ ID NO: 281552
  misc_feature: GYAE6OF02IQRJK.1.24.C02.1.454.CMB.1.raw
  modified_base (154)..(154): a, c, t, g, unknown or other
  misc_feature (154)..(154): n is a, c, g, or t

SEQ ID NO: 282937 - DNA, 154 bp, Homo sapiens; identical to SEQ ID NO: 281552
  misc_feature: GYAE6OF02G1GMU.1.24.C02.1.454.CMB.1.raw
  modified_base (154)..(154): a, c, t, g, unknown or other
  misc_feature (154)..(154): n is a, c, g, or t

SEQ ID NO: 282938 - DNA, 154 bp, Homo sapiens; identical to SEQ ID NO: 281552
  misc_feature: GYAE6OF02GNHFY.1.24.C02.1.454.CMB.1.raw
  modified_base (154)..(154): a, c, t, g, unknown or other
  misc_feature (154)..(154): n is a, c, g, or t

SEQ ID NO: 282939 - DNA, 155 bp, Homo sapiens
  misc_feature: GYAE6OF02HQFWL.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttaggacaagggaccaaggtggagatcaaacgaactgtggctgcaccatctgtcttcatcttcccgccatctgaatagcgtactctgagcgggctggcaaggcgcatagnn

SEQ ID NO: 282940 - DNA, 154 bp, Homo sapiens; identical to SEQ ID NO: 281552
  misc_feature: GYAE6OF02JCLBY.1.24.C02.1.454.CMB.1.raw
  modified_base (154)..(154): a, c, t, g, unknown or other
  misc_feature (154)..(154): n is a, c, g, or t

SEQ ID NO: 282941 - DNA, 154 bp, Homo sapiens; identical to SEQ ID NO: 281998
  misc_feature: GYAE6OF02G0MYR.1.24.C02.1.454.CMB.1.raw
  modified_base (154)..(154): a, c, t, g, unknown or other
  misc_feature (154)..(154): n is a, c, g, or t

SEQ ID NO: 282942 - DNA, 154 bp, Homo sapiens; identical to SEQ ID NO: 281607
  misc_feature: GYAE6OF02GB83R.1.24.C02.1.454.CMB.1.raw
  modified_base (154)..(154): a, c, t, g, unknown or other
  misc_feature (154)..(154): n is a, c, g, or t

SEQ ID NO: 282943 - DNA, 169 bp, Homo sapiens
  misc_feature: GYAE6OF02GE1FZ.1.24.C02.1.454.CMB.1.raw
  modified_base (154)..(169): a, c, t, g, unknown or other
  misc_feature (154)..(169): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnnnnnnnnnnnnn

SEQ ID NO: 282944 - DNA, 155 bp, Homo sapiens; identical to SEQ ID NO: 282702
  misc_feature: GYAE6OF02G5UJM.1.24.C02.1.454.CMB.1.raw
  modified_base (154)..(155): a, c, t, g, unknown or other
  misc_feature (154)..(155): n is a, c, g, or t

SEQ ID NO: 282945 - DNA, 191 bp, Homo sapiens
  misc_feature: GYAE6OF02GQJGC.1.24.C02.1.454.CMB.1.raw
  modified_base (152)..(152): a, c, t, g, unknown or other
  misc_feature (152)..(152): n is a, c, g, or t
  modified_base (157)..(158): a, c, t, g, unknown or other
  misc_feature (157)..(158): n is a, c, g, or t
  modified_base (161)..(191): a, c, t, g, unknown or other
  misc_feature (161)..(191): n is a, c, g, or t
tcagacgagtgcgtcacgaccggtgctcgatttagtacagatcgttagggaaagggaccaaggtgggagatcaaacgaactggtggctgcaccatctgcttcatcttcccggccatctgatatacgatcgctgagcgggctggcaaggccgnatagnngannnnnnnnnnnnnnnnnnnnnnnnnnnnnnn

SEQ ID NO: 282946 - DNA, 177 bp, Homo sapiens
  misc_feature: GYAE6OF02HPW6X.1.24.C02.1.454.CMB.1.raw
  modified_base (157)..(177): a, c, t, g, unknown or other
  misc_feature (157)..(177): n is a, c, g, or t
tcagacgagtgcgtcacgaccggtgctcgatttagtacagatcgttagggcaagggaccaaggtgtagatcaaaccgaactgtggctgcaccatctgtcttcatcttcccgccatcctgaatagcgtactctgagcgggctggcaaggcgcagtagnnnnnnnnnnnnnnnnnnnnn

SEQ ID NO: 282947 - DNA, 155 bp, Homo sapiens; identical to SEQ ID NO: 281693
  misc_feature: GYAE6OF02HHOFY.1.24.C02.1.454.CMB.1.raw
  modified_base (154)..(155): a, c, t, g, unknown or other
  misc_feature (154)..(155): n is a, c, g, or t

SEQ ID NO: 282948 - DNA, 154 bp, Homo sapiens; identical to SEQ ID NO: 281552
  misc_feature: GYAE6OF02GST2K.1.24.C02.1.454.CMB.1.raw
  modified_base (154)..(154): a, c, t, g, unknown or other
  misc_feature (154)..(154): n is a, c, g, or t

SEQ ID NO: 282949 - DNA, 119 bp, Homo sapiens
  misc_feature: GYAE6OF02G8H3O.1.24.C02.1.454.CMB.1.raw
  modified_base (119)..(119): a, c, t, g, unknown or other
  misc_feature (119)..(119): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatn

SEQ ID NO: 282950 - DNA, 157 bp, Homo sapiens
  misc_feature: GYAE6OF02IBZ2W.1.24.C02.1.454.CMB.1.raw
  modified_base (145)..(145): a, c, t, g, unknown or other
  misc_feature (145)..(145): n is a, c, g, or t
  modified_base (150)..(157): a, c, t, g, unknown or other
  misc_feature (150)..(157): n is a, c, g, or t
tcagacgagtgcgtcacgaccggtgctcgatttagtacagatcgttaggcaagggaccaaggtgtagatcaaacgaactgtggctgcaccatctgtcttcatcttcccgcatctgaatagcgtactctgagcggctggcaaggcnatagnnnnnnnn

SEQ ID NO: 282951 - DNA, 179 bp, Homo sapiens
  misc_feature: GYAE6OF02ID3WI.1.24.C02.1.454.CMB.1.raw
  modified_base (153)..(179): a, c, t, g, unknown or other
  misc_feature (153)..(179): n is a, c, g, or t
tcagacgagtgcgtcacgaccggtgctcgatttagtacagatcgttagggcgaagggaccaaggtggagatcaaacgaactgtggctgcaccatctgtcttcatcttcccgcctctcacgtagcgtgctgagcgggctggcaaggcgcatagnnnnnnnnnnnnnnnnnnnnnnnnnnn

SEQ ID NO: 282952 - DNA, 154 bp, Homo sapiens; identical to SEQ ID NO: 281641
  misc_feature: GYAE6OF02I9AUH.1.24.C02.1.454.CMB.1.raw
  modified_base (154)..(154): a, c, t, g, unknown or other
  misc_feature (154)..(154): n is a, c, g, or t

SEQ ID NO: 282953 - DNA, 167 bp, Homo sapiens
  misc_feature: GYAE6OF02G5V0J.1.24.C02.1.454.CMB.1.raw
  modified_base (155)..(167): a, c, t, g, unknown or other
  misc_feature (155)..(167): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatacgatcgctgagcggggctggcaaggcgcatagnnnnnnnnnnnnn

SEQ ID NO: 282954 - DNA, 154 bp, Homo sapiens; identical to SEQ ID NO: 281552
  misc_feature: GYAE6OF02IDZ0U.1.24.C02.1.454.CMB.1.raw
  modified_base (154)..(154): a, c, t, g, unknown or other
  misc_feature (154)..(154): n is a, c, g, or t

SEQ ID NO: 282955 - DNA, 178 bp, Homo sapiens
  misc_feature: GYAE6OF02H0S0W.1.24.C02.1.454.CMB.1.raw
  modified_base (157)..(178): a, c, t, g, unknown or other
  misc_feature (157)..(178): n is a, c, g, or t
tcagacgagtgcgtcacgaccggtgctcgatttagtacagatcgttagggaaagggaccaagggtggagatcaaacgaactgtggctgcgaccatctgtcttcatcttcccgccatctgattatacgatcgctgagcgggctggcaaggcgcatagnnnnnnnnnnnnnnnnnnnnnn

SEQ ID NO: 282956 - DNA, 156 bp, Homo sapiens; identical to SEQ ID NO: 281762
  misc_feature: GYAE6OF02JJHK4.1.24.C02.1.454.CMB.1.raw
  modified_base (154)..(156): a, c, t, g, unknown or other
  misc_feature (154)..(156): n is a, c, g, or t

SEQ ID NO: 282957 - DNA, 174 bp, Homo sapiens
  misc_feature: GYAE6OF02GH2NP.1.24.C02.1.454.CMB.1.raw
  modified_base (155)..(174): a, c, t, g, unknown or other
  misc_feature (155)..(174): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctggagcgggctggcaaggcgcatagnnnnnnnnnnnnnnnnnnnn

SEQ ID NO: 282958 - DNA, 154 bp, Homo sapiens; identical to SEQ ID NO: 281641
  misc_feature: GYAE6OF02G0VED.1.24.C02.1.454.CMB.1.raw
  modified_base (154)..(154): a, c, t, g, unknown or other
  misc_feature (154)..(154): n is a, c, g, or t

SEQ ID NO: 282959 - DNA, 154 bp, Homo sapiens; identical to SEQ ID NO: 281552
  misc_feature: GYAE6OF02FNJAK.1.24.C02.1.454.CMB.1.raw
  modified_base (154)..(154): a, c, t, g, unknown or other
  misc_feature (154)..(154): n is a, c, g, or t

SEQ ID NO: 282960 - DNA, 159 bp, Homo sapiens
  misc_feature: GYAE6OF02GZNBG.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaacgcactcgtctgagcgggctggcaaggcgcatagnnnnnn

SEQ ID NO: 282961 - DNA, 155 bp, Homo sapiens; identical to SEQ ID NO: 281555
  misc_feature: GYAE6OF02GTWH1.1.24.C02.1.454.CMB.1.raw
  modified_base (154)..(155): a, c, t, g, unknown or other
  misc_feature (154)..(155): n is a, c, g, or t

SEQ ID NO: 282962 - DNA, 155 bp, Homo sapiens; identical to SEQ ID NO: 282170
  misc_feature: GYAE6OF02FK55O.1.24.C02.1.454.CMB.1.raw
  modified_base (154)..(155): a, c, t, g, unknown or other
  misc_feature (154)..(155): n is a, c, g, or t

SEQ ID NO: 282963 - DNA, 172 bp, Homo sapiens
  misc_feature: GYAE6OF02F3R7D.1.24.C02.1.454.CMB.1.raw
  modified_base (156)..(172): a, c, t, g, unknown or other
  misc_feature (156)..(172): n is a, c, g, or t
tcagacgagtgcgtcacgaccggtgctcgatttagtacagatcgttagggaaagggaccaaggtggagatcaaacgaactgttgctgcaccatctgtcttcatcttcccgccatctgatcgtagcactctggagcgggctggcaaggcgcagtagnnnnnnnnnnnnnnnnn

SEQ ID NO: 282964 - DNA, 161 bp, Homo sapiens
  misc_feature: GYAE6OF02HEILS.1.24.C02.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnnnnn

SEQ ID NO: 282965 - DNA, 153 bp, Homo sapiens; identical to SEQ ID NO: 282155
  misc_feature: GYAE6OF02FJ79E.1.24.C02.1.454.CMB.1.raw

SEQ ID NO: 282966 - DNA, 154 bp, Homo sapiens
  misc_feature: GYAE6OF02F7ZQR.1.24.C02.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacagatcgttagggcaagggaccaaggtggagatcaaacgaactgtggctgaaccatctgtcttcatcttcccgtcatctgaatagcgtactctgagcgggctggcaaggcgcatagn

SEQ ID NO: 282967 - DNA, 161 bp, Homo sapiens; identical to SEQ ID NO: 281600
  misc_feature: GYAE6OF02F623K.1.24.C02.1.454.CMB.1.raw
  modified_base (154)..(161): a, c, t, g, unknown or other
  misc_feature (154)..(161): n is a, c, g, or t

SEQ ID NO: 282968 - DNA, 154 bp, Homo sapiens; identical to SEQ ID NO: 282873
  misc_feature: GYAE6OF02FMSD6.1.24.C02.1.454.CMB.1.raw
  modified_base (154)..(154): a, c, t, g, unknown or other
  misc_feature (154)..(154): n is a, c, g, or t

SEQ ID NO: 282969 - DNA, 157 bp, Homo sapiens
  misc_feature: GYAE6OF02FWL7P.1.24.C02.1.454.CMB.1.raw
  modified_base (157)..(157): a, c, t, g, unknown or other
  misc_feature (157)..(157): n is a, c, g, or t
tcagacgagtgcgtcacgaccggtgctcgatttagtacagatcgttagggtcgaagggaccgaaggtggagatcaaacgaactgtggctgaaccatctgtcttcatcttcccgccatctgaatagcgtactctgagcgggctggcaaggcgcatagn

SEQ ID NO: 282970 - DNA, 174 bp, Homo sapiens
  misc_feature: GYAE6OF02H15D6.1.24.C02.1.454.CMB.1.raw
  modified_base (155)..(174): a, c, t, g, unknown or other
  misc_feature (155)..(174): n is a, c, g, or t
tcagacgagtgcgtcacgaccggtgctcgatttagtacagatcgttagggcaagggaccaaggtgggagatcaaacgaactgtggctgcaccatctgtcttcatcttcccgccatctgaatagcgtactctgagcgggctggcaaggcgcatagnnnnnnnnnnnnnnnnnnnn

SEQ ID NO: 282971 - DNA, 153 bp, Homo sapiens; identical to SEQ ID NO: 281618
  misc_feature: GYAE6OF02FGV8O.1.24.C02.1.454.CMB.1.raw
  modified_base (153)..(153): a, c, t, g, unknown or other
  misc_feature (153)..(153): n is a, c, g, or t

SEQ ID NO: 282972 - DNA, 188 bp, Homo sapiens
  misc_feature: GYAE6OF02FJ1V4.1.24.C02.1.454.CMB.1.raw
  modified_base (160)..(188): a, c, t, g, unknown or other
  misc_feature (160)..(188): n is a, c, g, or t
tcagacgagtgcgtcacgaccggtgctcgatttagtacagatcgttagggcaaggggaccaaggtggagatccaaacgaactgtggctgcaccatctgtcttcgactcttcccgccatctggaatacgcgtactctgagcgggctggcaaggcgcatagnnnnnnnnnnnnnnnnnnnnnnnnnnnnn

SEQ ID NO: 282973 - DNA, 154 bp, Homo sapiens; identical to SEQ ID NO: 281576
  misc_feature: GYAE6OF02IEHVR.1.24.C02.1.454.CMB.1.raw
  modified_base (154)..(154): a, c, t, g, unknown or other
  misc_feature (154)..(154): n is a, c, g, or t

SEQ ID NO: 282974 - DNA, 154 bp, Homo sapiens; identical to SEQ ID NO: 281968
  misc_feature: GYAE6OF02GDSG2.1.24.C02.1.454.CMB.1.raw
  modified_base (154)..(154): a, c, t, g, unknown or other
  misc_feature (154)..(154): n is a, c, g, or t

SEQ ID NO: 282975 - DNA, 216 bp, Homo sapiens
  misc_feature: GYAE6OF02JII1P.1.24.C02.1.454.CMB.1.raw
  modified_base (157)..(216): a, c, t, g, unknown or other
  misc_feature (157)..(216): n is a, c, g, or t
tcagacgagtgcgtcacgaccggtgctcgatttagtacagatcgtttagggtcgaagggaccaaggtggagatcaaacgaactgtggctagcaccatctgtcttcatcttcccgcctcctcacgtagcgtgctgagcgggctggcaaggcgcatagnnnnnnnnnnnnnnnnnnnnnnnnnnnnnnnnnnnnnnnnnnnnnnnnnnnnnnnnnnnn

SEQ ID NO: 282976 - DNA, 155 bp, Homo sapiens; identical to SEQ ID NO: 281799
  misc_feature: GYAE6OF02H33BK.1.24.C02.1.454.CMB.1.raw
  modified_base (154)..(155): a, c, t, g, unknown or other
  misc_feature (154)..(155): n is a, c, g, or t

SEQ ID NO: 282977 - DNA, 155 bp, Homo sapiens; identical to SEQ ID NO: 281555
  misc_feature: GYAE6OF02HSMW5.1.24.C02.1.454.CMB.1.raw
  modified_base (154)..(155): a, c, t, g, unknown or other
  misc_feature (154)..(155): n is a, c, g, or t

SEQ ID NO: 282978 - DNA, 155 bp, Homo sapiens; identical to SEQ ID NO: 281693
  misc_feature: GYAE6OF02GC7BO.1.24.C02.1.454.CMB.1.raw
  modified_base (154)..(155): a, c, t, g, unknown or other
  misc_feature (154)..(155): n is a, c, g, or t

SEQ ID NO: 282979 - DNA, 155 bp, Homo sapiens; identical to SEQ ID NO: 281555
  misc_feature: GYAE6OF02IA1SE.1.24.C02.1.454.CMB.1.raw
  modified_base (154)..(155): a, c, t, g, unknown or other
  misc_feature (154)..(155): n is a, c, g, or t

SEQ ID NO: 282980 - DNA, 211 bp, Homo sapiens
  misc_feature: GYAE6OF02GH4I0.1.24.C02.1.454.CMB.1.raw
  modified_base (160)..(211): a, c, t, g, unknown or other
  misc_feature (160)..(211): n is a, c, g, or t
tcagacgagtgcgtcacgaccggtgctcgatttagtacagatcgttagggtcaagggaccaaggtggagatcaaacgaactgtaggctgcaaccatctgtcttcatcttcccgccatctgaatacgcgtactcgtgagcgggctggcaaggcgcataggnnnnnnnnnnnnnnnnnnnnnnnnnnnnnnnnnnnnnnnnnnnnnnnnnnnn

SEQ ID NO: 282981 - DNA, 155 bp, Homo sapiens; identical to SEQ ID NO: 281555
  misc_feature: GYAE6OF02FOL96.1.24.C02.1.454.CMB.1.raw
  modified_base (154)..(155): a, c, t, g, unknown or other
  misc_feature (154)..(155): n is a, c, g, or t

SEQ ID NO: 282982 - DNA, 163 bp, Homo sapiens
  misc_feature: GYAE6OF02I8I3A.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggcaagggaccgaaggtggagatcaaacgaactgtggctgcaccatctgtcttcatcttcccgccatctgaatagcgtactctgagcgggctggcaaggcgcatagnnnnnnnnn

SEQ ID NO: 282983 - DNA, 154 bp, Homo sapiens; identical to SEQ ID NO: 281607
  misc_feature: GYAE6OF02GPATP.1.24.C02.1.454.CMB.1.raw
  modified_base (154)..(154): a, c, t, g, unknown or other
  misc_feature (154)..(154): n is a, c, g, or t

SEQ ID NO: 282984 - DNA, 177 bp, Homo sapiens
  misc_feature: GYAE6OF02HFWDR.1.24.C02.1.454.CMB.1.raw
  modified_base (152)..(177): a, c, t, g, unknown or other
  misc_feature (152)..(177): n is a, c, g, or t
tcagacgagtgcgtcacgaccggtgctcgatttagtacagatcgttagggcaagggaccaaggtggagatcaaacgactgtgctgaaccatctgtcttcatcttcccgccatctgaatagcgtactctgagcgggctggcaaggcgcatagnnnnnnnnnnnnnnnnnnnnnnnnnn

SEQ ID NO: 282985 - DNA, 156 bp, Homo sapiens; identical to SEQ ID NO: 282176
  misc_feature: GYAE6OF02JB306.1.24.C02.1.454.CMB.1.raw
  modified_base (154)..(156): a, c, t, g, unknown or other
  misc_feature (154)..(156): n is a, c, g, or t

SEQ ID NO: 282986 - DNA, 154 bp, Homo sapiens; identical to SEQ ID NO: 281552
  misc_feature: GYAE6OF02HUMSV.1.24.C02.1.454.CMB.1.raw
  modified_base (154)..(154): a, c, t, g, unknown or other
  misc_feature (154)..(154): n is a, c, g, or t

SEQ ID NO: 282987 - DNA, 153 bp, Homo sapiens; identical to SEQ ID NO: 282155
  misc_feature: GYAE6OF02FKZ8O.1.24.C02.1.454.CMB.1.raw

SEQ ID NO: 282988 - DNA, 157 bp, Homo sapiens; identical to SEQ ID NO: 281599
  misc_feature: GYAE6OF02FL5T9.1.24.C02.1.454.CMB.1.raw
  modified_base (154)..(157): a, c, t, g, unknown or other
  misc_feature (154)..(157): n is a, c, g, or t

SEQ ID NO: 282989 - DNA, 153 bp, Homo sapiens
  misc_feature: GYAE6OF02I8Y71.1.24.C02.1.454.CMB.1.raw
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgcatag

SEQ ID NO: 282990 - DNA, 156 bp, Homo sapiens; identical to SEQ ID NO: 281595
  misc_feature: GYAE6OF02GWQPK.1.24.C02.1.454.CMB.1.raw
  modified_base (154)..(156): a, c, t, g, unknown or other
  misc_feature (154)..(156): n is a, c, g, or t

SEQ ID NO: 282991 - DNA, 154 bp, Homo sapiens; identical to SEQ ID NO: 281552
  misc_feature: GYAE6OF02FX6TM.1.24.C02.1.454.CMB.1.raw
  modified_base (154)..(154): a, c, t, g, unknown or other
  misc_feature (154)..(154): n is a, c, g, or t

SEQ ID NO: 282992 - DNA, 154 bp, Homo sapiens; identical to SEQ ID NO: 282245
  misc_feature: GYAE6OF02I6ACP.1.24.C02.1.454.CMB.1.raw
  modified_base (153)..(154): a, c, t, g, unknown or other
  misc_feature (153)..(154): n is a, c, g, or t

SEQ ID NO: 282993 - DNA, 153 bp, Homo sapiens; identical to SEQ ID NO: 282002
  misc_feature: GYAE6OF02GTUYF.1.24.C02.1.454.CMB.1.raw

SEQ ID NO: 282994 - DNA, 156 bp, Homo sapiens; identical to SEQ ID NO: 281888
  misc_feature: GYAE6OF02FM4KZ.1.24.C02.1.454.CMB.1.raw
  modified_base (154)..(156): a, c, t, g, unknown or other
  misc_feature (154)..(156): n is a, c, g, or t

SEQ ID NO: 282995 - DNA, 155 bp, Homo sapiens; identical to SEQ ID NO: 281753
  misc_feature: GYAE6OF02JJ67A.1.24.C02.1.454.CMB.1.raw
  modified_base (154)..(155): a, c, t, g, unknown or other
  misc_feature (154)..(155): n is a, c, g, or t

SEQ ID NO: 282996 - DNA, 154 bp, Homo sapiens; identical to SEQ ID NO: 281681
  misc_feature: GYAE6OF02FWXUH.1.24.C02.1.454.CMB.1.raw
  modified_base (154)..(154): a, c, t, g, unknown or other
  misc_feature (154)..(154): n is a, c, g, or t

SEQ ID NO: 282997 - DNA, 166 bp, Homo sapiens
  misc_feature: GYAE6OF02GOVK9.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgaatagcgtactctgagcgggctggcaaggcgcatagnnnnnnnnnnnn

SEQ ID NO: 282998 - DNA, 156 bp, Homo sapiens
  misc_feature: GYAE6OF02H22OF.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgactcgcgatatctgagcgggctggcaaggcgcatagnnnn

SEQ ID NO: 282999 - DNA, 171 bp, Homo sapiens
  misc_feature: GYAE6OF02IJ3L6.1.24.C02.1.454.CMB.1.raw
  modified_base (154)..(171): a, c, t, g, unknown or other
  misc_feature (154)..(171): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctggcaaggcgcatagnnnnnnnnnnnnnnnnnn

SEQ ID NO: 283000 - DNA, 153 bp, Homo sapiens
  misc_feature: GYAE6OF02GQ5CQ.1.24.C02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgactctgagcgggctggcaaggcgcatagn

SEQ ID NO: 283001 - DNA, 155 bp, Homo sapiens; identical to SEQ ID NO: 282704
  misc_feature: GYAE6OF02GZCJG.1.24.C02.1.454.CMB.1.raw
  modified_base (154)..(155): a, c, t, g, unknown or other
  misc_feature (154)..(155): n is a, c, g, or t

SEQ ID NO: 283002 - DNA, 154 bp, Homo sapiens; identical to SEQ ID NO: 281572
  misc_feature: GYAE6OF02HDZQF.1.24.C02.1.454.CMB.1.raw
  modified_base (154)..(154): a, c, t, g, unknown or other
  misc_feature (154)..(154): n is a, c, g, or t

SEQ ID NO: 283003 - DNA, 154 bp, Homo sapiens; identical to SEQ ID NO: 281552
  misc_feature: GYAE6OF02GD156.1.24.C02.1.454.CMB.1.raw
  modified_base (154)..(154): a, c, t, g, unknown or other
  misc_feature (154)..(154): n is a, c, g, or t

SEQ ID NO: 283004 - DNA, 154 bp, Homo sapiens; identical to SEQ ID NO: 281552
  misc_feature: GYAE6OF02IWEQB.1.24.C02.1.454.CMB.1.raw
  modified_base (154)..(154): a, c, t, g, unknown or other
  misc_feature (154)..(154): n is a, c, g, or t

SEQ ID NO: 283005 - DNA, 153 bp, Homo sapiens; identical to SEQ ID NO: 282002
  misc_feature: GYAE6OF02FLT6B.1.24.C02.1.454.CMB.1.raw

SEQ ID NO: 283006 - DNA, 155 bp, Homo sapiens; identical to SEQ ID NO: 281555
  misc_feature: GYAE6OF02IOI6Z.1.24.C02.1.454.CMB.1.raw
  modified_base (154)..(155): a, c, t, g, unknown or other
  misc_feature (154)..(155): n is a, c, g, or t

SEQ ID NO: 283007 - DNA, 155 bp, Homo sapiens; identical to SEQ ID NO: 281555
  misc_feature: GYAE6OF02ICQZS.1.24.C02.1.454.CMB.1.raw
  modified_base (154)..(155): a, c, t, g, unknown or other
  misc_feature (154)..(155): n is a, c, g, or t

SEQ ID NO: 283008 - DNA, 155 bp, Homo sapiens; identical to SEQ ID NO: 281555
  misc_feature: GYAE6OF02HSMD8.1.24.C02.1.454.CMB.1.raw
  modified_base (154)..(155): a, c, t, g, unknown or other
  misc_feature (154)..(155): n is a, c, g, or t

SEQ ID NO: 283009 - DNA, 164 bp, Homo sapiens
  misc_feature: GYAE6OF02JRPI0.1.24.C02.1.454.CMB.1.raw
  modified_base (156)..(164): a, c, t, g, unknown or other
  misc_feature (156)..(164): n is a, c, g, or t
tcagacgagtgcgtcacgaccggtgctcgatttagtacagatcgttagggcaagggaccaaggtggagatcaaacgaacctgtggctgcaccatctgtcttcatcttcccgccatctgaactagcgtactctgagcgggctggcaaggcgcatagnnnnnnnnn

SEQ ID NO: 283010 - DNA, 178 bp, Homo sapiens
  misc_feature: GYAE6OF02IP8ZA.1.24.C02.1.454.CMB.1.raw
  modified_base (156)..(178): a, c, t, g, unknown or other
  misc_feature (156)..(178): n is a, c, g, or t
tcagacgagtgcgtcacgaccggtgctcgatttagtacagatcgttagggcaagggacccaaggtgggagatcaaacgaactgtggctgcaccatctgtcttcatcttcccgccatctgaatagcgtactctgagcgggctggcaaggcgcatagnnnnnnnnnnnnnnnnnnnnnnn

SEQ ID NO: 283011 - DNA, 155 bp, Homo sapiens; identical to SEQ ID NO: 281799
  misc_feature: GYAE6OF02GIR4K.1.24.C02.1.454.CMB.1.raw
  modified_base (154)..(155): a, c, t, g, unknown or other
  misc_feature (154)..(155): n is a, c, g, or t

SEQ ID NO: 283012 - DNA, 164 bp, Homo sapiens
  misc_feature: GYAE6OF02IDDB3.1.24.C02.1.454.CMB.1.raw
  modified_base (155)..(164): a, c, t, g, unknown or other
  misc_feature (155)..(164): n is a, c, g, or t
tcagacgagtgcgtcacgaccggtgctcgatttagtacagatcgttagggaaatgggaccaaggtggagatcaaacgaactgtggctgcaccatctgtcttcatcttcccaccctcctcatagcgtactctgagcgggctggcaaggcgcatagnnnnnnnnnn

SEQ ID NO: 283013 - DNA, 154 bp, Homo sapiens; identical to SEQ ID NO: 281604
  misc_feature: GYAE6OF02IQVM6.1.24.C02.1.454.CMB.1.raw
  modified_base (154)..(154): a, c, t, g, unknown or other
  misc_feature (154)..(154): n is a, c, g, or t

SEQ ID NO: 283014 - DNA, 154 bp, Homo sapiens; identical to SEQ ID NO: 281552
  misc_feature: GYAE6OF02HDMTQ.1.24.C02.1.454.CMB.1.raw
  modified_base (154)..(154): a, c, t, g, unknown or other
  misc_feature (154)..(154): n is a, c, g, or t

SEQ ID NO: 283015 - DNA, 613 bp, Homo sapiens
  misc_feature: GYAE6OF02FYPO6.1.24.C02.1.454.CMB.1.raw
  modified_base (179)..(179): a, c, t, g, unknown or other
  misc_feature (179)..(179): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
tcagacgagtgcgtcacgaccggtgctcgatttagtacagatcgttagggtcgaagggaccgaaggtggagacctccaaacggtaacctgtggtctgctaccgatctgtcttcatcttcccgccatctagaatagcgtactcgtgtaggccgggctggcctaagggtccgtctagtagnttagntcntngngtgcagntgtgngngtggngctgcngcgtcgggcgtgagctctctgncncnctctcgtctctacgtctagtattatgtctatcgtcgtcgtcgtccgtcgcgtcgtacggacggacggacgagtacgtacgtcgtacgtacgtagtagtaagtaacgtagtacgaacgtaactaactactaagtatagtacgtacgtaacgtacgtagtagacgtacgtactacgtaccgtaccgtactaccgtacgacgacgtaacgtaaccgaacgtaacgtacgtacgtacgtaacgtacgtaacgtagtacgacgtacgtcgacgagacgtacgtacgtacgacgtacgtacgtagttacgtacgtggtcggtacggtaggtaggtagtaggtacggtacggtaggtaggtacggtacggacggtcgg

SEQ ID NO: 283016 - DNA, 154 bp, Homo sapiens; identical to SEQ ID NO: 281572
  misc_feature: GYAE6OF02GBRSO.1.24.C02.1.454.CMB.1.raw
  modified_base (154)..(154): a, c, t, g, unknown or other
  misc_feature (154)..(154): n is a, c, g, or t

SEQ ID NO: 283017 - DNA, 154 bp, Homo sapiens; identical to SEQ ID NO: 281607
  misc_feature: GYAE6OF02FLP67.1.24.C02.1.454.CMB.1.raw
  modified_base (154)..(154): a, c, t, g, unknown or other
  misc_feature (154)..(154): n is a, c, g, or t

SEQ ID NO: 283018 - DNA, 155 bp, Homo sapiens
  misc_feature: GYAE6OF02IFJA6.1.24.C02.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtacagatcgttagggaaagggaccaaggtggagatcaaacgaactgttgctgcaccatctgtcttaatcttcccgccatctgatcgtagcactctgagcgggctggcaaggcgcatagnn

SEQ ID NO: 283019 - DNA, 155 bp, Homo sapiens; identical to SEQ ID NO: 281931
  misc_feature: GYAE6OF02I9HV8.1.24.C02.1.454.CMB.1.raw
  modified_base (154)..(155): a, c, t, g, unknown or other
  misc_feature (154)..(155): n is a, c, g, or t

SEQ ID NO: 283020 - DNA, 179 bp, Homo sapiens
  misc_feature: GYAE6OF02IXMIY.1.24.C02.1.454.CMB.1.raw
  modified_base (152)..(179): a, c, t, g, unknown or other
  misc_feature (152)..(179): n is a, c, g, or t
tcagacgagtgcgtcacgaccggtgctcgatttagtacagatcgttagggcaagggaccaaggtgagatcaaacgaactgtggctgcaccatctgtcttcatcttccgccatctgaatagcgtactctgagcgggctggcaaggcgcatagnnnnnnnnnnnnnnnnnnnnnnnnnnnn

SEQ ID NO: 283021 - DNA, 157 bp, Homo sapiens; identical to SEQ ID NO: 282522
  misc_feature: GYAE6OF02FY75M.1.24.C02.1.454.CMB.1.raw
  modified_base (154)..(157): a, c, t, g, unknown or other
  misc_feature (154)..(157): n is a, c, g, or t

SEQ ID NO: 283022 - DNA, 157 bp, Homo sapiens; identical to SEQ ID NO: 282630
  misc_feature: GYAE6OF02ICZLG.1.24.C02.1.454.CMB.1.raw
  modified_base (154)..(157): a, c, t, g, unknown or other
  misc_feature (154)..(157): n is a, c, g, or t

SEQ ID NO: 283023 - DNA, 154 bp, Homo sapiens; identical to SEQ ID NO: 281552
  misc_feature: GYAE6OF02F31LU.1.24.C02.1.454.CMB.1.raw
  modified_base (154)..(154): a, c, t, g, unknown or other
  misc_feature (154)..(154): n is a, c, g, or t

SEQ ID NO: 283024 - DNA, 162 bp, Homo sapiens
  misc_feature: GYAE6OF02JLFND.1.24.C02.1.454.CMB.1.raw
  modified_base (155)..(155): a, c, t, g, unknown or other
  misc_feature (155)..(155): n is a, c, g, or t
  modified_base (157)..(162): a, c, t, g, unknown or other
  misc_feature (157)..(162): n is a, c, g, or t
tcagacgagtgcgtcacgaccggtgctcgatttagtacagatcgttagggcaagggaccaaggtggagatcaaacgaactgtggctgcaccatctgtcttcatcttcccgcactctgaatagcgtactctgagcgggctggcaaggcgctatagntnnnnnn

SEQ ID NO: 283025 - DNA, 156 bp, Homo sapiens; identical to SEQ ID NO: 281741
  misc_feature: GYAE6OF02FJY1W.1.24.C02.1.454.CMB.1.raw
  modified_base (154)..(156): a, c, t, g, unknown or other
  misc_feature (154)..(156): n is a, c, g, or t

SEQ ID NO: 283026 - DNA, 156 bp, Homo sapiens
  misc_feature: GYAE6OF02GJ3RV.1.24.C02.1.454.CMB.1.raw
  modified_base (153)..(156): a, c, t, g, unknown or other
  misc_feature (153)..(156): n is a, c, g, or t
tcagacgagtgcgtcacgaccggtgctcgatttagtacagatcgttagggaagggaccaaggtggagatcaaacgaactgtggctgcaccatctgtcttcatcttcccgccatctgaatagcgtactctgagcgggctggcaaggcgcatagnnnn

SEQ ID NO: 283027 - DNA, 160 bp, Homo sapiens
  misc_feature: GYAE6OF02IHB5W.1.24.C02.1.454.CMB.1.raw
  modified_base (154)..(156): a, c, t, g, unknown or other
  misc_feature (154)..(156): n is a, c, g, or t
  modified_base (159)..(160): a, c, t, g, unknown or other
  misc_feature (159)..(160): n is a, c, g, or t
tcagacgagtgcgtcacgaccggtgctcgatttagtacagatcgttaggaaagtgaccaaggtggagatcaaactaactgtggactgcaccatctgtcttcatcttcccgccatctgatcgtactgcgctgagcgggctggcaaggcgcatagnnnatnn

SEQ ID NO: 283028 - DNA, 169 bp, Homo sapiens
  misc_feature: GYAE6OF02H0AJJ.1.24.C02.1.454.CMB.1.raw
  modified_base (154)..(169): a, c, t, g, unknown or other
  misc_feature (154)..(169): n is a, c, g, or t
tcagacgagtgcgtcacgaccggtgctcgatttagtacagatcgttagggaaagggaccaaggtggagatcaaacgaactgtggctgcaccatctgtcttcatcttcccgccatcctgatcgtagcactcgagcgggctggcaaggcgcatagnnnnnnnnnnnnnnnn

SEQ ID NO: 283029 - DNA, 155 bp, Homo sapiens; identical to SEQ ID NO: 281555
  misc_feature: GYAE6OF02JJ4J0.1.24.C02.1.454.CMB.1.raw
  modified_base (154)..(155): a, c, t, g, unknown or other
  misc_feature (154)..(155): n is a, c, g, or t

SEQ ID NO: 283030 - DNA, 155 bp, Homo sapiens
  misc_feature: GYAE6OF02GWB1R.1.24.C02.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgaatagcgtactctgagcgggctggcaaggcgcatagnnn

SEQ ID NO: 283031 - DNA, 157 bp, Homo sapiens
  misc_feature: GYAE6OF02HJWG1.1.24.C02.1.454.CMB.1.raw
  modified_base (154)..(157): a, c, t, g, unknown or other
  misc_feature (154)..(157): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatatgtatactctgagcgggctggcaaggcgcatagnnnn

SEQ ID NO: 283032 - DNA, 158 bp, Homo sapiens; identical to SEQ ID NO: 281713
  misc_feature: GYAE6OF02IYMC9.1.24.C02.1.454.CMB.1.raw
  modified_base (154)..(158): a, c, t, g, unknown or other
  misc_feature (154)..(158): n is a, c, g, or t

SEQ ID NO: 283033 - DNA, 244 bp, Homo sapiens
  misc_feature: GYAE6OF02HEIQ1.1.24.C02.1.454.CMB.1.raw
  modified_base (103)..(103): a, c, t, g, unknown or other
  misc_feature (103)..(103): n is a, c, g, or t
  modified_base (163)..(165): a, c, t, g, unknown or other
  misc_feature (163)..(165): n is a, c, g, or t
  modified_base (168)..(244): a, c, t, g, unknown or other
  misc_feature (168)..(244): n is a, c, g, or t
tcagacgagtgcgtcacgaccggtgctcgatttagtacagatcgttagggaaaggtgaccaagggtggagatcaaactaactgtggctgcaccatctgtcttnatcttcccgcatctgatcgtactgcggctggagcgggctgggacaagggctacaataggnnnatnnnnnnnnnnnnnnnnnnnnnnnnnnnnnnnnnnnnnnnnnnnnnnnnnnnnnnnnnnnnnnnnnnnnnnnnnnnnn

SEQ ID NO: 283034 - DNA, 188 bp, Homo sapiens
  misc_feature: GYAE6OF02HREIL.1.24.C02.1.454.CMB.1.raw
  modified_base (158)..(188): a, c, t, g, unknown or other
  misc_feature (158)..(188): n is a, c, g, or t
tcagacgagtgcgtcacgaccggtgctcgatttagtacagatcgttagggaaagggaccaagggtggagatcaaacgaactgtggctggcaccatcctgtcttcatcttcccaccctcctcacgcactcgtctcgagcgggctggcaaggcgcatagnnnnnnnnnnnnnnnnnnnnnnnnnnnnnnn

SEQ ID NO: 283035 - DNA, 175 bp, Homo sapiens
  misc_feature: GYAE6OF02GXIYB.1.24.C02.1.454.CMB.1.raw
  modified_base (156)..(175): a, c, t, g, unknown or other
  misc_feature (156)..(175): n is a, c, g, or t
tcagacgagtgcgtcacgaccggtgctcgatttagtacagatcgttagggaagggtaccgaaggtggagatcaaacgaactgtggctgcaccatctgtcttcatcgttccccgcatctgaatagcgtactctgagcgggctggcaaggcgcatagnnnnnnnnnnnnnnnnnnnn

SEQ ID NO: 283036 - DNA, 154 bp, Homo sapiens; identical to SEQ ID NO: 281604
  misc_feature: GYAE6OF02IROBL.1.24.C02.1.454.CMB.1.raw
  modified_base (154)..(154): a, c, t, g, unknown or other
  misc_feature (154)..(154): n is a, c, g, or t

SEQ ID NO: 283037 - DNA, 156 bp, Homo sapiens; identical to SEQ ID NO: 282783
  misc_feature: GYAE6OF02F7E0U.1.24.C02.1.454.CMB.1.raw
  modified_base (154)..(156): a, c, t, g, unknown or other
  misc_feature (154)..(156): n is a, c, g, or t

SEQ ID NO: 283038 - DNA, 156 bp, Homo sapiens; identical to SEQ ID NO: 281661
  misc_feature: GYAE6OF02JC6W2.1.24.C02.1.454.CMB.1.raw
  modified_base (154)..(156): a, c, t, g, unknown or other
  misc_feature (154)..(156): n is a, c, g, or t

SEQ ID NO: 283039 - DNA, 157 bp, Homo sapiens
  misc_feature: GYAE6OF02HOZQX.1.24.C02.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtacagatcgttagggcaagggaccaaggtggagatcaaaacgaactgtggctgcaccatctgtcttcatcttcccgccatctgaatagcgtactctgagcgggctggcaaggcgcatagnnn

SEQ ID NO: 283040 - DNA, 157 bp, Homo sapiens; identical to SEQ ID NO: 281964
  misc_feature: GYAE6OF02FOPOZ.1.24.C02.1.454.CMB.1.raw
  modified_base (154)..(157): a, c, t, g, unknown or other
  misc_feature (154)..(157): n is a, c, g, or t

SEQ ID NO: 283041 - DNA, 154 bp, Homo sapiens; identical to SEQ ID NO: 281681
  misc_feature: GYAE6OF02FJZGI.1.24.C02.1.454.CMB.1.raw
  modified_base (154)..(154): a, c, t, g, unknown or other
  misc_feature (154)..(154): n is a, c, g, or t

SEQ ID NO: 283042 - DNA, 154 bp, Homo sapiens; identical to SEQ ID NO: 281609
  misc_feature: GYAE6OF02FYR0I.1.24.C02.1.454.CMB.1.raw
  modified_base (154)..(154): a, c, t, g, unknown or other
  misc_feature (154)..(154): n is a, c, g, or t

SEQ ID NO: 283043 - DNA, 154 bp, Homo sapiens; identical to SEQ ID NO: 281641
  misc_feature: GYAE6OF02F7N7Y.1.24.C02.1.454.CMB.1.raw
  modified_base (154)..(154): a, c, t, g, unknown or other
  misc_feature (154)..(154): n is a, c, g, or t

SEQ ID NO: 283044 - DNA, 184 bp, Homo sapiens
  misc_feature: GYAE6OF02HVZ2C.1.24.C02.1.454.CMB.1.raw
  modified_base (155)..(157): a, c, t, g, unknown or other
  misc_feature (155)..(157): n is a, c, g, or t
  modified_base (159)..(184): a, c, t, g, unknown or other
  misc_feature (159)..(184): n is a, c, g, or t
tcagacgagtgcgtcacgaccggtgctcgatttagtacagatcgttagggaagggaccaaggtgagatcaaacgaactgttgctcgcaccatctgtcttcatccttcccgccatctgatcgtagcactctgagcgggcttggcaaggcgcatagnnngnnnnnnnnnnnnnnnnnnnnnnnnnn

SEQ ID NO: 283045 - DNA, 154 bp, Homo sapiens; identical to SEQ ID NO: 281552
  misc_feature: GYAE6OF02GNI0Q.1.24.C02.1.454.CMB.1.raw
  modified_base (154)..(154): a, c, t, g, unknown or other
  misc_feature (154)..(154): n is a, c, g, or t

SEQ ID NO: 283046 - DNA, 161 bp, Homo sapiens; identical to SEQ ID NO: 281600
  misc_feature: GYAE6OF02HB12L.1.24.C02.1.454.CMB.1.raw
  modified_base (154)..(161): a, c, t, g, unknown or other
  misc_feature (154)..(161): n is a, c, g, or t

SEQ ID NO: 283047 - DNA, 178 bp, Homo sapiens
  misc_feature: GYAE6OF02JDAWK.1.24.C02.1.454.CMB.1.raw
  modified_base (157)..(159): a, c, t, g, unknown or other
  misc_feature (157)..(159): n is a, c, g, or t
  modified_base (161)..(178): a, c, t, g, unknown or other
  misc_feature (161)..(178): n is a, c, g, or t
tcagacgagtgcgtcacgaccggtgctcgatttagtacagatcgttagggcaagggaccaaggtggagatcgaacgaactgtaggctgcaccatctgtcttcatcttcccgccatctgtaatagcgtactctgagtcgggctggcaaggcgcatagnnntnnnnnnnnnnnnnnnnnn

SEQ ID NO: 283048 - DNA, 155 bp, Homo sapiens; identical to SEQ ID NO: 281931
  misc_feature: GYAE6OF02FTPQL.1.24.C02.1.454.CMB.1.raw
  modified_base (154)..(155): a, c, t, g, unknown or other
  misc_feature (154)..(155): n is a, c, g, or t

SEQ ID NO: 283049 - DNA, 158 bp, Homo sapiens
  misc_feature: GYAE6OF02JSOQJ.1.24.C02.1.454.CMB.1.raw
  modified_base (153)..(158): a, c, t, g, unknown or other
  misc_feature (153)..(158): n is a, c, g, or t
tcagacgagtgcgtcacgaccggtgctcgatttagtacagatcgttagggaaagggaccaaggtggagatcaaactaactgtggctgcacaatctgtcttcatcttcccgcatctgatcgtactgcgctgagcgggctggcaaggcgcatagnnnnnn

SEQ ID NO: 283050 - DNA, 168 bp, Homo sapiens
  misc_feature: GYAE6OF02GD1H7.1.24.C02.1.454.CMB.1.raw
  modified_base (154)..(168): a, c, t, g, unknown or other
  misc_feature (154)..(168): n is a, c, g, or t
tcagacgagtgcgtcacgaccggtgctcgatttagtacagatcgttagggaaagtgaccaaggtggagatcaaactaactgtggctgcaccatctgtcttcatcttcccgccatctgatcgtactgcgctgagcgggctggcaaggcgcatagnnnnnnnnnnnnnnn

SEQ ID NO: 283051 - DNA, 155 bp, Homo sapiens; identical to SEQ ID NO: 281753
  misc_feature: GYAE6OF02IHRMY.1.24.C02.1.454.CMB.1.raw
  modified_base (154)..(155): a, c, t, g, unknown or other
  misc_feature (154)..(155): n is a, c, g, or t

SEQ ID NO: 283052 - DNA, 162 bp, Homo sapiens
  misc_feature: GYAE6OF02H3YOT.1.24.C02.1.454.CMB.1.raw
  modified_base (153)..(162): a, c, t, g, unknown or other
  misc_feature (153)..(162): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgatctctcgactctgagcgggctggcaaggcgcatagnnnnnnnnnn

SEQ ID NO: 283053 - DNA, 159 bp, Homo sapiens; identical to SEQ ID NO: 281835
  misc_feature: GYAE6OF02GC3D4.1.24.C02.1.454.CMB.1.raw
  modified_base (154)..(159): a, c, t, g, unknown or other
  misc_feature (154)..(159): n is a, c, g, or t

SEQ ID NO: 283054 - DNA, 155 bp, Homo sapiens; identical to SEQ ID NO: 281799
  misc_feature: GYAE6OF02FVJAM.1.24.C02.1.454.CMB.1.raw
  modified_base (154)..(155): a, c, t, g, unknown or other
  misc_feature (154)..(155): n is a, c, g, or t

SEQ ID NO: 283055 - DNA, 155 bp, Homo sapiens; identical to SEQ ID NO: 281555
  misc_feature: GYAE6OF02GQC2Q.1.24.C02.1.454.CMB.1.raw
  modified_base (154)..(155): a, c, t, g, unknown or other
  misc_feature (154)..(155): n is a, c, g, or t

SEQ ID NO: 283056 - DNA, 157 bp, Homo sapiens; identical to SEQ ID NO: 281597
  misc_feature: GYAE6OF02JZL18.1.24.C02.1.454.CMB.1.raw
  modified_base (153)..(157): a, c, t, g, unknown or other
  misc_feature (153)..(157): n is a, c, g, or t

SEQ ID NO: 283057 - DNA, 170 bp, Homo sapiens
  misc_feature: GYAE6OF02HZIR5.1.24.C02.1.454.CMB.1.raw
  modified_base (128)..(128): a, c, t, g, unknown or other
  misc_feature (128)..(128): n is a, c, g, or t
  modified_base (153)..(170): a, c, t, g, unknown or other
  misc_feature (153)..(170): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactntgagcgggctggcaaggcgcatagnnnnnnnnnnnnnnnnnn

SEQ ID NO: 283058 - DNA, 159 bp, Homo sapiens; identical to SEQ ID NO: 282758
  misc_feature: GYAE6OF02FMIKT.1.24.C02.1.454.CMB.1.raw
  modified_base (154)..(159): a, c, t, g, unknown or other
  misc_feature (154)..(159): n is a, c, g, or t

SEQ ID NO: 283059 - DNA, 154 bp, Homo sapiens; identical to SEQ ID NO: 281604
  misc_feature: GYAE6OF02FSUE8.1.24.C02.1.454.CMB.1.raw
  modified_base (154)..(154): a, c, t, g, unknown or other
  misc_feature (154)..(154): n is a, c, g, or t

SEQ ID NO: 283060 - DNA, 161 bp, Homo sapiens; identical to SEQ ID NO: 281600
  misc_feature: GYAE6OF02I6TRZ.1.24.C02.1.454.CMB.1.raw
  modified_base (154)..(161): a, c, t, g, unknown or other
  misc_feature (154)..(161): n is a, c, g, or t

SEQ ID NO: 283061 - DNA, 184 bp, Homo sapiens
  misc_feature: GYAE6OF02GGW8P.1.24.C02.1.454.CMB.1.raw
  modified_base (156)..(159): a, c, t, g, unknown or other
  misc_feature (156)..(159): n is a, c, g, or t
  modified_base (161)..(184): a, c, t, g, unknown or other
  misc_feature (161)..(184): n is a, c, g, or t
tcagacgagtgcgtcacgaccggtgctcgatttagtacagatcgttagggcaagggaccaaggtggagatcaaacgaactgtgctgaaccatctgtcttcatcttcccgccatctgaatagcgtactctgacgcgggctggcaaggcgacattagnnnntnnnnnnnnnnnnnnnnnnnnnnnn

SEQ ID NO: 283062 - DNA, 260 bp, Homo sapiens
  misc_feature: GYAE6OF02GIGPY.1.24.C02.1.454.CMB.1.raw
  modified_base (256)..(260): a, c, t, g, unknown or other
  misc_feature (256)..(260): n is a, c, g, or t
tcagacgagtgcgtcacgaccggtgctcgatttagtacagatcgttcgcgggaagatgaagacagatttcactctcaccatcagcagcctgcagcctgaagattttgcaacttattactgtcaacagcttaatagttacccttacacttttggccaggggaccaagctggagatcaaacgaactgtggctgcaccatctgtcttcatcttcccacctcctcacgcactcgtctgagcggctggcaaggcgcatagnnnnn

SEQ ID NO: 283063 - DNA, 155 bp, Homo sapiens; identical to SEQ ID NO: 281555
  misc_feature: GYAE6OF02GP76G.1.24.C02.1.454.CMB.1.raw
  modified_base (154)..(155): a, c, t, g, unknown or other
  misc_feature (154)..(155): n is a, c, g, or t

SEQ ID NO: 283064 - DNA, 162 bp, Homo sapiens
  misc_feature: GYAE6OF02HMVK5.1.24.C02.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacagatcgttagggcaagggaccaaggtggagatcaaacgaactgtggctgaaccatctgtcttcatcttcccgccatctgaatagcgtactctgagcgggctggcaaggcgcatagnnnnnnnnn

SEQ ID NO: 283065 - DNA, 198 bp, Homo sapiens
  misc_feature: GYAE6OF02H2T0S.1.24.C02.1.454.CMB.1.raw
  modified_base (128)..(128): a, c, t, g, unknown or other
  misc_feature (128)..(128): n is a, c, g, or t
  modified_base (153)..(198): a, c, t, g, unknown or other
  misc_feature (153)..(198): n is a, c, g, or t
tcagacgagtgcgtcacgaccggtgctcgatttagtacagatcgttagggcaagggaccaaggtggagatcaaacgaacctgtggctgcaccatctgtcttcatcttcccgcatctgaatgcgtactntgagcggctggacaaggcgcatagnnnnnnnnnnnnnnnnnnnnnnnnnnnnnnnnnnnnnnnnnnnnnn

SEQ ID NO: 283066 - DNA, 155 bp, Homo sapiens; identical to SEQ ID NO: 281575
  misc_feature: GYAE6OF02GK477.1.24.C02.1.454.CMB.1.raw
  modified_base (154)..(155): a, c, t, g, unknown or other
  misc_feature (154)..(155): n is a, c, g, or t

SEQ ID NO: 283067 - DNA, 155 bp, Homo sapiens; identical to SEQ ID NO: 281591
  misc_feature: GYAE6OF02HIW3F.1.24.C02.1.454.CMB.1.raw
  modified_base (154)..(155): a, c, t, g, unknown or other
  misc_feature (154)..(155): n is a, c, g, or t

SEQ ID NO: 283068 - DNA, 158 bp, Homo sapiens
  misc_feature: GYAE6OF02I24PD.1.24.C02.1.454.CMB.1.raw
  modified_base (128)..(128): a, c, t, g, unknown or other
  misc_feature (128)..(128): n is a, c, g, or t
  modified_base (152)..(158): a, c, t, g, unknown or other
  misc_feature (152)..(158): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactntgagcggctggcaaggcgcatagnnnnnnn

SEQ ID NO: 283069 - DNA, 158 bp, Homo sapiens; identical to SEQ ID NO: 282361
  misc_feature: GYAE6OF02I8AI0.1.24.C02.1.454.CMB.1.raw
  modified_base (154)..(158): a, c, t, g, unknown or other
  misc_feature (154)..(158): n is a, c, g, or t

SEQ ID NO: 283070 - DNA, 155 bp, Homo sapiens; identical to SEQ ID NO: 281753
  misc_feature: GYAE6OF02G0LXY.1.24.C02.1.454.CMB.1.raw
  modified_base (154)..(155): a, c, t, g, unknown or other
  misc_feature (154)..(155): n is a, c, g, or t

SEQ ID NO: 283071 - DNA, 158 bp, Homo sapiens; identical to SEQ ID NO: 281713
  misc_feature: GYAE6OF02JX9KY.1.24.C02.1.454.CMB.1.raw
  modified_base (154)..(158): a, c, t, g, unknown or other
  misc_feature (154)..(158): n is a, c, g, or t

SEQ ID NO: 283072 - DNA, 153 bp, Homo sapiens; identical to SEQ ID NO: 282002
  misc_feature: GYAE6OF02H23NT.1.24.C02.1.454.CMB.1.raw

SEQ ID NO: 283073 - DNA, 158 bp, Homo sapiens
  misc_feature: GYAE6OF02FRLBE.1.24.C02.1.454.CMB.1.raw
  modified_base (154)..(158): a, c, t, g, unknown or other
  misc_feature (154)..(158): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatctctcgactctgagcgggctggcaaggcgcatagnnnnn

SEQ ID NO: 283074 - DNA, 160 bp, Homo sapiens
  misc_feature: GYAE6OF02HGL3S.1.24.C02.1.454.CMB.1.raw
  modified_base (151)..(160): a, c, t, g, unknown or other
  misc_feature (151)..(160): n is a, c, g, or t
tcagacgagtgcgtcacgaccggtgctcgatttagtacagatcgttagggcaagggaccaaggtggagatcaaacgaactgtggctgcaccatctgtcttcatctcccgcatctgaatagctactctgagcgggtctggcaaggcgcatgnnnnnnnnnn

SEQ ID NO: 283075 - DNA, 160 bp, Homo sapiens
  misc_feature: GYAE6OF02IAF5M.1.24.C02.1.454.CMB.1.raw
  modified_base (153)..(160): a, c, t, g, unknown or other
  misc_feature (153)..(160): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnnnnnnnn

SEQ ID NO: 283076 - DNA, 160 bp, Homo sapiens; identical to SEQ ID NO: 281714
  misc_feature: GYAE6OF02FJYKA.1.24.C02.1.454.CMB.1.raw
  modified_base (154)..(160): a, c, t, g, unknown or other
  misc_feature (154)..(160): n is a, c, g, or t

SEQ ID NO: 283077 - DNA, 170 bp, Homo sapiens
  misc_feature: GYAE6OF02GPZ9G.1.24.C02.1.454.CMB.1.raw
  modified_base (154)..(170): a, c, t, g, unknown or other
  misc_feature (154)..(170): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctggcaaggcgcatagnnnnnnnnnnnnnnnnn

SEQ ID NO: 283078 - DNA, 163 bp, Homo sapiens
  misc_feature: GYAE6OF02FWELH.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgagcgggctgggcaaggcgcatagnnnnnnnnn

SEQ ID NO: 283079 - DNA, 211 bp, Homo sapiens
  misc_feature: GYAE6OF02H0G6X.1.24.C02.1.454.CMB.1.raw
  modified_base (131)..(131): a, c, t, g, unknown or other
  misc_feature (131)..(131): n is a, c, g, or t
  modified_base (160)..(211): a, c, t, g, unknown or other
  misc_feature (160)..(211): n is a, c, g, or t
tcagacgagtgcgtcacgaccggtgctcgatttagtacagatcgttagggcaaagggaccaaggtggagatcaaacgaactgtggctgcaccatctgtcttcatcttcccgccatctgaatagcgtacctntagaggcgggtctggcaaggcgcaatagnnnnnnnnnnnnnnnnnnnnnnnnnnnnnnnnnnnnnnnnnnnnnnnnnnnn

SEQ ID NO: 283080 - DNA, 156 bp, Homo sapiens
  misc_feature: GYAE6OF02FT43P.1.24.C02.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgactcgcgatatctgagcgggctgggcaaggcgcatagnn

SEQ ID NO: 283081 - DNA, 174 bp, Homo sapiens
  misc_feature: GYAE6OF02H3ENW.1.24.C02.1.454.CMB.1.raw
  modified_base (164)..(174): a, c, t, g, unknown or other
  misc_feature (164)..(174): n is a, c, g, or t
tcagacgagtgcgtcacgaccggtgctcgatttagtacagatcgttagggcaagggaccaaggtggagatcaaaacgaactgtggctgcacatctgtcttctactcttcccgtccatctgtaataagcgtactactgagcgggcgtggacgaaggacgcatagnnnnnnnnnnn

SEQ ID NO: 283082 - DNA, 163 bp, Homo sapiens
  misc_feature: GYAE6OF02JIGT1.1.24.C02.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacagatcgttagggcaagggaccaaggtggagatcaaacgaactgtggctgcaccatctgtcttcatctttcccgccatctgaatagcgtactctgagcgggctggcaaggcgcatagnnnnnnnnn

SEQ ID NO: 283083 - DNA, 613 bp, Homo sapiens
  misc_feature: GYAE6OF02H5BCP.1.24.C02.1.454.CMB.1.raw
  modified_base (152)..(152): a, c, t, g, unknown or other
  misc_feature (152)..(152): n is a, c, g, or t
  modified_base (160)..(161): a, c, t, g, unknown or other
  misc_feature (160)..(161): n is a, c, g, or t
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
tcagacgagtgcgtcacgaccggtgctcgatttagtacagatcgttagggaaaggggaccaaggtggagatcaaacgaactgtggctgcaccatctgtcttcatcttcccgcatctgaatagctactctgagcgggactggacaagggccgnaacttagnngntacagcntcactgtnaggntatcgncgcgnaagtcgntacctgccaggattgacatanacgtnaaccgngtactngtaactganaccgattacgcttagaacgcnttaccnttggaanccttaacatccgtnaaacggttcaacgttcncgttacacgtncgtagacgatcgtacgacncgtgcnaacgncggttaaccgtntaacgacgttnaggtacccagttacgcgacgttagacctacgtacgtacgtacgtagttagtcccgtaacgtacccgttaagcggtacgtaacgacggttcggtaaacgttccggtaacgtacgtacggttaaccggtacgttaacggcgtaaccggacgtaccgtagtaaccggtaccgtacgtacgtacggtacgttactaccgtacctacggtttaccgtccgtaccggtttaccgtccgtaccg

SEQ ID NO: 283084 - DNA, 185 bp, Homo sapiens
  misc_feature: GYAE6OF02G3GA3.1.24.C02.1.454.CMB.1.raw
  modified_base (155)..(185): a, c, t, g, unknown or other
  misc_feature (155)..(185): n is a, c, g, or t
tcagacgagtgcgtcacgaccggtgctcgatttagtacagatcgttagggcaagggaccaaggtggagatcaaaacgaactgtggctgcaccatctgtcttcatcttcccgccatctgaatagcgtactctgagcgggctggcaaggcgcatagnnnnnnnnnnnnnnnnnnnnnnnnnnnnnnn

SEQ ID NO: 283085 - DNA, 159 bp, Homo sapiens
  misc_feature: GYAE6OF02J1RFQ.1.24.C02.1.454.CMB.1.raw
  modified_base (154)..(159): a, c, t, g, unknown or other
  misc_feature (154)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgatcgtagcactctgagcgggctggcaaggcgcatagnnnnnn

SEQ ID NO: 283086 - DNA, 163 bp, Homo sapiens
  misc_feature: GYAE6OF02FHB1G.1.24.C02.1.454.CMB.1.raw
  modified_base (153)..(163): a, c, t, g, unknown or other
  misc_feature (153)..(163): n is a, c, g, or t
tcagacgagtgcgtcacgaccggtgctcgatttagtacagatcgttagggcaagggaccaaggtggagatcaaacgaactgtggctgcaccatctgtcttcatcttcccgcatctgaatagcgtactctgagcgggctggcaaggcgcatagnnnnnnnnnnn

SEQ ID NO: 283087 - DNA, 154 bp, Homo sapiens; identical to SEQ ID NO: 281644
  misc_feature: GYAE6OF02HTOUF.1.24.C02.1.454.CMB.1.raw
  modified_base (154)..(154): a, c, t, g, unknown or other
  misc_feature (154)..(154): n is a, c, g, or t

SEQ ID NO: 283088 - DNA, 187 bp, Homo sapiens
  misc_feature: GYAE6OF02GM9G2.1.24.C02.1.454.CMB.1.raw
  modified_base (159)..(187): a, c, t, g, unknown or other
  misc_feature (159)..(187): n is a, c, g, or t
tcagacgagtgcgtcacgaccggtgctcgatttagtacagatcgttagggcaaggggaccaaggtggagatcaaacgaactgtggctgcaccatctgtcttcatcttcccgccatcctgaatagcgtactctgagccgggctgggccaaggcgcatagnnnnnnnnnnnnnnnnnnnnnnnnnnnnn

SEQ ID NO: 283089 - DNA, 166 bp, Homo sapiens
  misc_feature: GYAE6OF02FPQH7.1.24.C02.1.454.CMB.1.raw
  modified_base (154)..(166): a, c, t, g, unknown or other
  misc_feature (154)..(166): n is a, c, g, or t
tcagacgagtgcgtcacgaccggtgctcgatttagtacagatcgttagggaaagggaccaaggtggagatcaaacgaactgtggctgcaccatctgtcttcatcttcccgccctcctcacgtctactgctgagcgggctggcaaggcgcatagnnnnnnnnnnnnn

SEQ ID NO: 283090 - DNA, 169 bp, Homo sapiens
  misc_feature: GYAE6OF02G6FCE.1.24.C02.1.454.CMB.1.raw
  modified_base (149)..(149): a, c, t, g, unknown or other
  misc_feature (149)..(149): n is a, c, g, or t
  modified_base (155)..(169): a, c, t, g, unknown or other
  misc_feature (155)..(169): n is a, c, g, or t
tcagacgagtgcgtcacgaccggtgctcgatttagtacagatcgttagggcgaagggaccaaggtggagatcaaacgaactgtggctgcaccatctgtcttcatcttcccgccatctgatatgtatactctgagcgggctggcaaggcncatagnnnnnnnnnnnnnnn

SEQ ID NO: 283091 - DNA, 173 bp, Homo sapiens
  misc_feature: GYAE6OF02JB8AO.1.24.C02.1.454.CMB.1.raw
  modified_base (153)..(173): a, c, t, g, unknown or other
  misc_feature (153)..(173): n is a, c, g, or t
tcagacgagtgcgtcacgaccggtgctcgatttagtacagatcgttagggaaagggaccaaggtggagatcaaacgaactgtggctgcacatctgtcttcatcttcccgcatctgaacgcactcgtctgacgcgggctggcaaggcgcatagnnnnnnnnnnnnnnnnnnnnn

SEQ ID NO: 283092 - DNA, 195 bp, Homo sapiens
  misc_feature: GYAE6OF02JYVYE.1.24.C02.1.454.CMB.1.raw
  modified_base (159)..(159): a, c, t, g, unknown or other
  misc_feature (159)..(159): n is a, c, g, or t
  modified_base (161)..(162): a, c, t, g, unknown or other
  misc_feature (161)..(162): n is a, c, g, or t
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (181)..(195): a, c, t, g, unknown or other
  misc_feature (181)..(195): n is a, c, g, or t
tcagacgagtgcgtcacgaccggtgctcgatttagtacagatcgttagggcaagggaccaaggtggagatcaaacgaactgtggctgcaccatctgtcttcatcttccccgcatctgaactagcgtactctgagtcgggctggccaaggccgcataggntnngnangtacntancngntgnnnnnnnnnnnnnnn

SEQ ID NO: 283093 - DNA, 160 bp, Homo sapiens
  misc_feature: GYAE6OF02ISYT2.1.24.C02.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctcacgtctactgctgagcgggctggcaaggcgcatagnnnnnnn

SEQ ID NO: 283094 - DNA, 164 bp, Homo sapiens
  misc_feature: GYAE6OF02IUNYX.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgatatgtatactctgagcgggctggcaaggcgcatagnnnnnnnnnnn

SEQ ID NO: 283095 - DNA, 155 bp, Homo sapiens; identical to SEQ ID NO: 281825
  misc_feature: GYAE6OF02H5J4P.1.24.C02.1.454.CMB.1.raw
  modified_base (154)..(155): a, c, t, g, unknown or other
  misc_feature (154)..(155): n is a, c, g, or t

SEQ ID NO: 283096 - DNA, 183 bp, Homo sapiens
  misc_feature: GYAE6OF02F1V5M.1.24.C02.1.454.CMB.1.raw
  modified_base (159)..(183): a, c, t, g, unknown or other
  misc_feature (159)..(183): n is a, c, g, or t
tcagacgagtgcgtcacgaccggtgctcgatttagtacagatcgttagggcgaaggggaccaaggtggagatcaaacgaactgtggctgcaccagtcctgtcttcatccttcccgaccctcctcacgtagcgtgctgagcgggctggcaaggcgcatgnnnnnnnnnnnnnnnnnnnnnnnnn

SEQ ID NO: 283097 - DNA, 159 bp, Homo sapiens
  misc_feature: GYAE6OF02IR98V.1.24.C02.1.454.CMB.1.raw
  modified_base (153)..(159): a, c, t, g, unknown or other
  misc_feature (153)..(159): n is a, c, g, or t
tcagacgagtgcgtcacgaccggtgctcgatttagtacagatcgttagggaaagggaccaaggtggagatcaaacgaactgtggctgcaccatctgtcttcatcttcccgcatctgaatagcgtactctgagcgggctggcaaggcgcatagnnnnnnn

SEQ ID NO: 283098 - DNA, 181 bp, Homo sapiens
  misc_feature: GYAE6OF02H2O5W.1.24.C02.1.454.CMB.1.raw
  modified_base (158)..(162): a, c, t, g, unknown or other
  misc_feature (158)..(162): n is a, c, g, or t
  modified_base (164)..(166): a, c, t, g, unknown or other
  misc_feature (164)..(166): n is a, c, g, or t
  modified_base (168)..(168): a, c, t, g, unknown or other
  misc_feature (168)..(168): n is a, c, g, or t
  modified_base (170)..(181): a, c, t, g, unknown or other
  misc_feature (170)..(181): n is a, c, g, or t
tcagacgagtgcgtcacgaccggtgctcgatttagtacagatcgttagggcaagggaccaaggtaggagatcgaaacgaactgtaggctgcaccatctgtcttcatctcccgcatctgaatagcgtactctgagccggtctgggacaaggcgcatagnnnnntnnntncnnnnnnnnnnnn

SEQ ID NO: 283099 - DNA, 156 bp, Homo sapiens; identical to SEQ ID NO: 281661
  misc_feature: GYAE6OF02F6ZZ7.1.24.C02.1.454.CMB.1.raw
  modified_base (154)..(156): a, c, t, g, unknown or other
  misc_feature (154)..(156): n is a, c, g, or t

SEQ ID NO: 283100 - DNA, 167 bp, Homo sapiens
  misc_feature: GYAE6OF02GHE3Z.1.24.C02.1.454.CMB.1.raw
  modified_base (155)..(167): a, c, t, g, unknown or other
  misc_feature (155)..(167): n is a, c, g, or t
tcagacgagtgcgtcacgaccggtgctcgatttagtacagatcgttagggaaaggggaccaaggtggagatcaaacgaactgtggctgcaccatctgtcttcatcttcccgcatctgaatagcgtactctgagcgggctggcaagggcgcatagnnnnnnnnnnnnn

SEQ ID NO: 283101 - DNA, 166 bp, Homo sapiens
  misc_feature: GYAE6OF02JKXQZ.1.24.C02.1.454.CMB.1.raw
  modified_base (155)..(166): a, c, t, g, unknown or other
  misc_feature (155)..(166): n is a, c, g, or t
tcagacgagtgcgtcacgaccggtgctcgatttagtacagatcgttagggcaagggaccaaggtgtagatcaaacgaactgtggctgcaccatctgtcttcatcttcccgccatctgaatagcgtactctgaggcgggctggcaaggcgcatagnnnnnnnnnnnn

SEQ ID NO: 283102 - DNA, 219 bp, Homo sapiens
  misc_feature: GYAE6OF02IGF11.1.24.C02.1.454.CMB.1.raw
  modified_base (154)..(154): a, c, t, g, unknown or other
  misc_feature (154)..(154): n is a, c, g, or t
  modified_base (161)..(219): a, c, t, g, unknown or other
  misc_feature (161)..(219): n is a, c, g, or t
tcagacgagtgcgtcacgaccggtgctcgatttagtacagatcgttagggcaagggaccaaaggtggagatcaaaacgaactgtggctgcaccatctgtcttcatcttcccgcatctgaatagcgtactctggaggccggctggacaaggccgnaagtagnnnnnnnnnnnnnnnnnnnnnnnnnnnnnnnnnnnnnnnnnnnnnnnnnnnnnnnnnnn

SEQ ID NO: 283103 - DNA, 156 bp, Homo sapiens; identical to SEQ ID NO: 281610
  misc_feature: GYAE6OF02F6XQK.1.24.C02.1.454.CMB.1.raw
  modified_base (154)..(156): a, c, t, g, unknown or other
  misc_feature (154)..(156): n is a, c, g, or t

SEQ ID NO: 283104 - DNA, 181 bp, Homo sapiens
  misc_feature: GYAE6OF02IKKMN.1.24.C02.1.454.CMB.1.raw
  modified_base (149)..(149): a, c, t, g, unknown or other
  misc_feature (149)..(149): n is a, c, g, or t
  modified_base (155)..(181): a, c, t, g, unknown or other
  misc_feature (155)..(181): n is a, c, g, or t
tcagacgagtgcgtcacgaccggtgctcgatttagtacagatcgttagggcaagggaccaaaggtggagatcaaacgaactgtggctgcaccatctgtcttcatcttcccgcatctgaatagcgtactctgaggcgggctggcaaggcncaatgnnnnnnnnnnnnnnnnnnnnnnnnnnn

SEQ ID NO: 283105 - DNA, 185 bp, Homo sapiens
  misc_feature: GYAE6OF02IUTHX.1.24.C02.1.454.CMB.1.raw
  modified_base (153)..(185): a, c, t, g, unknown or other
  misc_feature (153)..(185): n is a, c, g, or t
tcagacgagtgcgtcacgaccggtgctcgatttagtacagatcgttagggaagtgaccaaggtggagatcaaactaactgtggctgcaccatctgtcttcatcttcccgcatctgatcgtactgcgactgagcgggctggcaaggcgcatagnnnnnnnnnnnnnnnnnnnnnnnnnnnnnnnnn

SEQ ID NO: 283106 - DNA, 159 bp, Homo sapiens
  misc_feature: GYAE6OF02GVZ3F.1.24.C02.1.454.CMB.1.raw
  modified_base (153)..(159): a, c, t, g, unknown or other
  misc_feature (153)..(159): n is a, c, g, or t
tcagacgagtgcgtcacgaccggtgctcgatttagtacagatcgttagggcaagggaccaaggtggagatcaaacgaactgtggctgcaccatctgtcttcatcttcccgccatctgaatagcgtactctgagcggctggcaaggcgcatagnnnnnnn

SEQ ID NO: 283107 - DNA, 163 bp, Homo sapiens
  misc_feature: GYAE6OF02H95PX.1.24.C02.1.454.CMB.1.raw
  modified_base (153)..(163): a, c, t, g, unknown or other
  misc_feature (153)..(163): n is a, c, g, or t
tcagacgagtgcgtcacgaccggtgctcgatttagtacagatcgttagggaaagggaccaaggtggagatcaaacgaactgtggctgcaccatctgtcttcatcttcccgcctcctctcgtactgcgctgagcgggctggcaaggcgcatagnnnnnnnnnnn

SEQ ID NO: 283108 - DNA, 164 bp, Homo sapiens; identical to SEQ ID NO: 282856
  misc_feature: GYAE6OF02F68JX.1.24.C02.1.454.CMB.1.raw
  modified_base (154)..(164): a, c, t, g, unknown or other
  misc_feature (154)..(164): n is a, c, g, or t

SEQ ID NO: 283109 - DNA, 187 bp, Homo sapiens
  misc_feature: GYAE6OF02FWKQG.1.24.C02.1.454.CMB.1.raw
  modified_base (155)..(187): a, c, t, g, unknown or other
  misc_feature (155)..(187): n is a, c, g, or t
tcagacgagtgcgtcacgaccggtgctcgatttagtacagatcgttagggaaagggaccaaggtggagatcaaacgaactgtggctgcaccatctgtcttcatcttcccgccatctgaatagcgtactctgagcgggctggacaaggcgcaatgnnnnnnnnnnnnnnnnnnnnnnnnnnnnnnnnn

SEQ ID NO: 283110 - DNA, 208 bp, Homo sapiens
  misc_feature: GYAE6OF02H26A6.1.24.C02.1.454.CMB.1.raw
  modified_base (163)..(208): a, c, t, g, unknown or other
  misc_feature (163)..(208): n is a, c, g, or t
tcagacgagtgcgtcacgaccggtgctcgatttagtacagatcgttagggaaagggaccaaggtggagatcaaacgaactgtggctgcaccatctgtcttcatccttcccgcatctgaatagcgtactctaggagccgggctggaccaaagggcgacaatagnnnnnnnnnnnnnnnnnnnnnnnnnnnnnnnnnnnnnnnnnnnnnn

SEQ ID NO: 283111 - DNA, 179 bp, Homo sapiens
  misc_feature: GYAE6OF02JZOMR.1.24.C02.1.454.CMB.1.raw
  modified_base (154)..(179): a, c, t, g, unknown or other
  misc_feature (154)..(179): n is a, c, g, or t
tcagacgagtgcgtcacgaccggtgctcgatttagtacagatcgttagggaaagggaccaaggtgagatcaaacgaactgtgctgcaccatctgtcttcatcttcccgccatctgatatacgatcgctgagcgggctaggcaaggcgcaagtgnnnnnnnnnnnnnnnnnnnnnnnnnn

SEQ ID NO: 283112 - DNA, 171 bp, Homo sapiens
  misc_feature: GYAE6OF02IN6X4.1.24.C02.1.454.CMB.1.raw
  modified_base (155)..(171): a, c, t, g, unknown or other
  misc_feature (155)..(171): n is a, c, g, or t
tcagacgagtgcgtcacgaccggtgctcgatttagtacagatcgttagggaaagggaccaaggtggagatcaaacgaactgtggctgcaccatctgtcttcatcttcccaccctcctctcgtactgcgctgaggcgggctggcaaggcgcatagnnnnnnnnnnnnnnnnn

SEQ ID NO: 283113 - DNA, 158 bp, Homo sapiens; identical to SEQ ID NO: 281807
  misc_feature: GYAE6OF02FPEBD.1.24.C02.1.454.CMB.1.raw
  modified_base (154)..(158): a, c, t, g, unknown or other
  misc_feature (154)..(158): n is a, c, g, or t

SEQ ID NO: 283114 - DNA, 177 bp, Homo sapiens
  misc_feature: GYAE6OF02JRLG7.1.24.C02.1.454.CMB.1.raw
  modified_base (155)..(177): a, c, t, g, unknown or other
  misc_feature (155)..(177): n is a, c, g, or t
tcagacgagtgcgtcacgaccggtgctcgatttagtacagatcgttaggcaagggaccaaggtggagatcaaacgaactgtggctgaaccatctgtcttcatcttcccgcatctgaactgcgtactctgagcggtctggccaaggccgctatagnnnnnnnnnnnnnnnnnnnnnnn

SEQ ID NO: 283115 - DNA, 164 bp, Homo sapiens
  misc_feature: GYAE6OF02GXFR6.1.24.C02.1.454.CMB.1.raw
  modified_base (154)..(164): a, c, t, g, unknown or other
  misc_feature (154)..(164): n is a, c, g, or t
tcagacgagtgcgtcacgaccggtgctcgatttagtacagatcgttagggaaagggaccaaggtggagatcaaacgaactgtggctgcaccatctgtcttcatctcccgccatctgaacgcactcgtctggagcgggctggcaaggcgcatagnnnnnnnnnnn

SEQ ID NO: 283116 - DNA, 215 bp, Homo sapiens
  misc_feature: GYAE6OF02F45DY.1.24.C02.1.454.CMB.1.raw
  modified_base (144)..(144): a, c, t, g, unknown or other
  misc_feature (144)..(144): n is a, c, g, or t
  modified_base (157)..(160): a, c, t, g, unknown or other
  misc_feature (157)..(160): n is a, c, g, or t
  modified_base (162)..(215): a, c, t, g, unknown or other
  misc_feature (162)..(215): n is a, c, g, or t
tcagacgagtgcgtcacgaccggtgctcgatttagtacagatcgttagggcaagggaccaaggtggagatcaaacgaactgtggctgcaccatctgtcttcatcttcccgccattctgaatagcgtactctcgagcgggctggnaaggccgcatagnnnngnnnnnnnnnnnnnnnnnnnnnnnnnnnnnnnnnnnnnnnnnnnnnnnnnnnnnn

SEQ ID NO: 283117 - DNA, 157 bp, Homo sapiens; identical to SEQ ID NO: 281964
  misc_feature: GYAE6OF02I1EHQ.1.24.C02.1.454.CMB.1.raw
  modified_base (154)..(157): a, c, t, g, unknown or other
  misc_feature (154)..(157): n is a, c, g, or t

SEQ ID NO: 283118 - DNA, 170 bp, Homo sapiens
  misc_feature: GYAE6OF02IMRLK.1.24.C02.1.454.CMB.1.raw
  modified_base (158)..(170): a, c, t, g, unknown or other
  misc_feature (158)..(170): n is a, c, g, or t
tcagacgagtgcgtcacgaccggtgctcgatttagtacagatcgttagggaaagggaccaaggtggagatcaaaactaactgtggctgcaccatctgtcttcatccttccccgccatctgatcgtactgcgctgaggccgggctggcaaggcgcatgnnnnnnnnnnnnn

SEQ ID NO: 283119 - DNA, 545 bp, Homo sapiens
  misc_feature: GYAE6OF01EV5S8.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctccatcagcagtggtactttttactacagttggagtcgccagcccccagggaagggactagagtggattgggagtgttcatcataatgggaggaccttctacagcccgtcctcaagagccgagtcaccatatcaaatggacacgtccaggaaccacctctccctgaaccctcaacctctacgttaccggccgcggaccacggcccgtgtacttagttggtgcgagggacggcccaaaagtcgggtaggccgactccggccttcgacttgacccgtcgtcggggccaggggaacgcgtagggtcagtccgtccg

SEQ ID NO: 283120 - DNA, 348 bp, Homo sapiens
  misc_feature: GYAE6OF01DCPRG.52.39.D06.1.454.CMB.1.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (329)..(348): a, c, t, g, unknown or other
  misc_feature (329)..(348): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcgactcgccttcacttgacctctggggccagggaaggctggtcatcgtctcctcagcctccaccaagggcccatcggtccttccccctggccnccctgctccaggagccaccgtccgagacgcacagccggcccctggggcttgcctggtcaaggcctacttccncgtatgcnctggagcgggctggcaaggcgcatagnnnnnnnnnnnnnnnnnnnn

SEQ ID NO: 283121 - DNA, 613 bp, Homo sapiens
  misc_feature: GYAE6OF01CS6MR.52.39.D06.1.454.CMB.1.raw
  modified_base (347)..(347): a, c, t, g, unknown or other
  misc_feature (347)..(347): n is a, c, g, or t
tcagcgcagtacgacacgaccggtgctcgatttagtgacatctcgcagttctttggggatgctttctgagagtcatggacctcctgtgcaagaacatgaagcacctgtggttctcctcctgctggtggcggctcccagatgggtcctgtcccagctgcagctgcaggagtcgggcccaggactggtgaagccttcggacgaccctgcccctcacctgcattgtgtctggtgctccatcagcagtggttacttttacactagttgagtcgccacgcccccgagggaagggactaggagtggattgggagtgttcatcatagtgggacgcttctacacgcccgtcctanaagacgccgagtcaccatatacaatggacacgtaccaggaaccacctctacccctcgaacctacaaccttctacgttaccggcccgacggtaccgaccggtccgttagtacgtttagtgtacggacggtaagggtacgaacccgtaaaggttgggtacggtaccgtaaccgttccggtacccttaccgtaccgtttacgacccgttcgggttcgggggacccgtaaggggtaaccggtcttacgggtacacggttccggttacccg

SEQ ID NO: 283122 - DNA, 549 bp, Homo sapiens
  misc_feature: GYAE6OF01DPNZE.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctcatcagcagtggtactttttactcgtaaaaagttggagtcgccagccccgtagggaagggactagaggtggagttgggagttgttcatcataagtgggagacttctacacgcccgtcctcaagagccgagtcaccatatacaatgacacgtccaacggaaccacctctaccctcgaacctcaactctgtacgccgcgacacgcgtgtattgtgtgcgagggacgaccaaagtggtacggcgacgtccgtaccgttcgtaccgttcgaccgttcgtcggggaccgacgggtacggcgtaggtcctagtcgttacccg

SEQ ID NO: 283123 - DNA, 587 bp, Homo sapiens
  misc_feature: GYAE6OF01CP9ZR.52.39.D06.1.454.CMB.1.raw
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (502)..(502): a, c, t, g, unknown or other
  misc_feature (502)..(502): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctccagatgggtcctgtcccagctgcagctgcaggagtcgggcccaaggctggtagaacgccttcgggacaccctgcccctcaccgttgactattgtcgtctggtcggcttcatcagcagttgtacttttacactagttgagtcgccacgccccgagggaaggtactggagtggatgggatgtcatcataagtggaagtcctctacgacgtccctccgtacagtacgccgtatcgaaccatactcgaatcggacacgtcaagtacccnctactcccgtanaccgttacaacttcgtcggttaccgccgacgacgaccggtcgtagttaagttctaggtcgacgggagggtaccgtaaccaaaggttcggngtaccgtactcccggtcttactacgttggaccctttcgggacgggtaccgacgggtaacgtcggtacgtcacgttccgttacccg

SEQ ID NO: 283124 - DNA, 617 bp, Homo sapiens
  misc_feature: GYAE6OF01CHKCT.52.39.D06.1.454.CMB.1.raw
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcggcccaggactggtgaagccttcggagaccctgcccctnacctgcattgtgtctggtgctccatcagcagtgtacttttacactagttggntcgccacgcccccaagggaacggactagagtggattgggagtgttcgatcataagtgggagtacttcacacgcccgtcctacgaagacgccgagtccaccatagtcaaagtcggaacacgtccaacggaaccacctctacccctacgaacctccgaactcgtcgttaaccggccgaccgacaccggtcttagtattgtcgtggacggacgggtacgaacccgtaaagtcgggtacggaccgtaccgtccgtcccgttaccgtaccgtttagggaccccttcggttacggggggaacccctaaggggggtaaacgggtcccgttagggtacccgtacggttcccggtttaccccg

SEQ ID NO: 283125 - DNA, 574 bp, Homo sapiens
  misc_feature: GYAE6OF01CF5N3.52.39.D06.1.454.CMB.1.raw
  modified_base (223)..(223): a, c, t, g, unknown or other
  misc_feature (223)..(223): n is a, c, g, or t
  modified_base (337)..(337): a, c, t, g, unknown or other
  misc_feature (337)..(337): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgngtctggtgctcatcagcagtggtactttttacacagttggatcgccagccccagggaaggactagagtgattgggatgtcatcataagtgggagacctttcacagcccgtcctnaagcgccgagtcaccatatcaatgacacgtcacggaaccacctctccctacgaacctacaactctcgttacggccgtcgaccgacggcgtgtattagttgtcggacgtagggacggaccgtaaaacgtgggtacggtcggacctccgtacccttcgtaccgttcgaacccgttccggtacggggtacccggtaaggggtaacggtccggttagggtccgtacggttaccggttcccg

SEQ ID NO: 283126 - DNA, 556 bp, Homo sapiens
  misc_feature: GYAE6OF01CPMG3.52.39.D06.1.454.CMB.1.raw
  modified_base (213)..(213): a, c, t, g, unknown or other
  misc_feature (213)..(213): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgcccctnacctgcattgtgtctggtggctccatcagcagtggtactttttactacagtttggagtcgccagcccccgagggaacgggactaggagtggaagttgggagtggttcaatcataagtgggagtaccttctacacgccccgtcctacaagacgccgagtacacctatactacaatgacaccgtcaacggaccactcctccctacgaacctacaactctcgtacgccgacgacncggctgtatagttgngcgaggtacgacctaaagtggtggcgacgtaccgtcgttcacgttcgaccttcggtacgggtaccgacgggaacggcgttaggctacgtcgtcccg

SEQ ID NO: 283127 - DNA, 635 bp, Homo sapiens
  misc_feature: GYAE6OF01DMPKK.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctccagatggtcctgtcccagctgcagctgcaggagtcgggcccaggactggtgaagccttcggacgaccctgcccctcacctgcattgtgtctggtgctccatcagcgtagttggttacttttactacgtagttggagtccgccacgcccccgagggaacggactaggagtggtagtgggagtgtcatcaagtaagtgggacgtacttactacgacgtccccgtaccctacgaacgacgaccgtagtaccaccgatacgtacaagtacgactacgtaccaacggaacccctacctcctaccccgtacgaaaccctacaaccttcgtacggttaccggacccgcggaccgacggtccgttgtacgttagttggacgtacgggaggaccggtaccgtaaaggttcgggacggtaccgtaccgtccgccgttaccgtaccgttcgacccgtcggtacggggaccgtaacggggtacggtacggttggtacctcgttccgtacccg

SEQ ID NO: 283128 - DNA, 679 bp, Homo sapiens
  misc_feature: GYAE6OF01D8HU7.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggccaggactggtgaagccgttcggacgaccctgcccctcacctgctattgtcgtctggtcgctccatcagcagttggttacttttactactagttggagtcgccgacgcccccgagggaaggactaggaggtggagttgggagtgttcatacaagtaagtgggacggtaccttcgtacgacgtcccgtacctacgaagacgccgagtcaccatacacaatcgacacgtaccaacggaaccacctcctaccctacgaaccctacaaccttccgtacggttaccggcccgacggaccgacgggtcccgttagttaactttagtcggtacggaccgggtaacggggtaaccggaacccgtaaaggtccgggtacggaccgtaccgttcccggtaccgttaccgtaaccgtttacggtacccgttcggggtacccgggggtacccggtaaacgggggtaaccgggttaccggttacgggtttaacccgtcggttcccgggttacccccg

SEQ ID NO: 283129 - DNA, 622 bp, Homo sapiens
  misc_feature: GYAE6OF01DJQRZ.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctctgctggtggcggctcccagatgggtcctgtcccagctgcagctgcaggagtcgggcccaggactggtgaagccttcggacgaccctgcccctcacctgcattgtgtctggtgctccatcagcagtggtactttttactactagttggagtcgccacgcccccgagggaaggactagaggtggagttgggagtgttcatcaataagtgggacgtaccttcgtacacgccccgtcctacaacgacgccgacgtacaccaatactacaagtaggaccaccgtaccaacggaaccctacctcctacccctacgaaacccttccaaccttcgtacgttacccggccgaccggacctaccgggccgttagttacttagttggtcggacgggtagggacggaacccaaagtcgggtacggaccgtaccgttccgtcccttacgtaccttcggaccgttcggtcgggggacccgaacggggtacggtacgtcggtactcgttcgttacccg

SEQ ID NO: 283130 - DNA, 793 bp, Homo sapiens
  misc_feature: GYAE6OF01APLVD.52.39.D06.1.454.CMB.1.raw
  modified_base (327)..(327): a, c, t, g, unknown or other
  misc_feature (327)..(327): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggacgtggtagaacgcccttcgggacgacccctcgccccctcacccgtgcctagttgtcgtccgtggtcgcctccatcgagctagttcggtttacttttacgacgtaggttggacgtcgccacggcccccgaaggggacggactaggnggtggagttgggagttgtacgtatacgtagtaaggtgggacgtaccttcgtaacgcgtccccgtaccgacgaacgacgccgtacgtaccgtaacctatactacgaaacgtacgaaccgtaaccggtaccgaaaccggtaacccctacccttacccgttacccccgtaaccgtaaccccgttaccctaaaccgttccccgttacgggttaccccgggtacccggtacccgggtaacccggaccgggttacccggttaggttaacgttttttttacgtaacgggttccgggtaccgggtaacggggtaacccggaaacccgttaaacgggtacggggttaccgggtaccggtaacccgttcccggttacccctttacccggttaaccgttcccgggttaacccgttccgggtacccggggaccggtaacggggtacgtcgggttacggtacgtcgttccggttacccg

SEQ ID NO: 283131 - DNA, 674 bp, Homo sapiens
  misc_feature: GYAE6OF01CVNLR.52.39.D06.1.454.CMB.1.raw
  modified_base (659)..(659): a, c, t, g, unknown or other
  misc_feature (659)..(659): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcctaggactggtgaagtccttacgggacgaccctgccccctcacctgcattgtgtctggtgctcatcagcagttggttactttttactactagttggagtccgcctacgcccccgaaggggaacggacgtagagtggagttggggtagtgttacagtacaagtaagtgggacgtaccttcgtacaccgcccgtcccgtacgaagacgccgacgtaccactaatactacaagtacgacaccgtccgaacgaacccacctacctacccctacgaaccctacctaacgtcctacggttaccgggcccgtaccggacccgtaccgggtcccgtttagttaacgtttacgttacggttacgggaccgggtaacggggaccggttaacccgaaaaggttcgggtacgggacccgtaccgtccgtcccttacgtaccgttcgacccgttcggtcggggtacccgaacggggtaacggtcgttacgggtacncgttccggttacccg

SEQ ID NO: 283132 - DNA, 866 bp, Homo sapiens
  misc_feature: GYAE6OF01CRT1P.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctctgctggtggcgctccagatggtcctgtcccagctgcagctgcaggacgtcgggcccaggactgggtagaagtccgttcggacgacccctcgcccctcacctgctagtttgtgtctggtcgcttccatcagcagttgttacttttaacactaggttggagtccgccgacgaccccgaagggaagggactaggagtggattggggagttcgtacatacgaataaggtcggggacgtacccttacgtaccgaccggtccccgttacccgtacgaaacgggaccgaccggtaacgtacccgaaaactacgttaaactacgtaaacgtacgggaacccgaaccggttacccgaaccgggtaaacccctaccccgtttaccctaacccccgttaacgtaaacccccgttaaccctaaccgtttacccgggttaaccgggtttaaccccgggaccccgggttaacccgggaacccgggtaacccggggttcccgttaacgggttttaacggttttaacggtttaccgggtaccgggtaacccgggggtaaacgggggtaaccgggtaaacccgtaaaaacgggttcgggggttaccgggtaacccgttaccggttaccccggttacccgtttaacccgttaaccccggtttaccggttaaccccggttcgggggttacccggggggacccggtaaacgggggtaaacgggttccggttaaccggggttccctaacgggttcccggtttccccgg

SEQ ID NO: 283133 - DNA, 616 bp, Homo sapiens
  misc_feature: GYAE6OF01BU2DE.52.39.D06.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcggcccaggactggtgaagccttcggganaccctgcccctnacctgcattgtgtctggtgctcatcagcagtgttacttttacacgtagttggagtcgcctacgcccccgagggaaggactagagtggagttgggagtgttcatcattagtgggacgtaccttctacacgcccgtacctacgaacgacgccgtacgtcacctatatacaatcggacacgtaccaacggaacccaccttcctcccctacgaaccctactaaccgttccgtacggttaccggcccgtaccggaccgccgggtccgttagttatttagtcgtacggcgggtagggacgtacccgtaaaggtcggtacggccgtacgtccgtccttacgtaccgttcgacccggttcggtacggggacccgaaggggtacggtacggttcggactacgtccgttacccg

SEQ ID NO: 283134 - DNA, 769 bp, Homo sapiens
  misc_feature: GYAE6OF01EI6E6.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctctgctggtggcgctccagatggtcctgtcccagctgcagctgcaggagtccgggcccaggacgtgggtagaacgtcccgttcgggacgtacccctcgccccctcacccgtgctattgtcgtcgtggtcggcctccatcagctagttggtttaacctttttactacgtaggtttggacgttccgcccgtacgccccccggaagggggtaacgggtactaggtaggtgggtaggtttggggtattgttacattacgaagtaagtggggacgtacctttacgaaccgacgtaccccgtaccctacgaaagacggtacccgtagtacccgaacctacgttaataccgtaaatccgggaaccgtaaccgtaccgaaacccggaacctaccccgttcccttaccccgtaccgtaacccttacctaaacccgttccgttaccggttacccggcccggtaccggaccgtaccgtaccggttacgtacgtttcgttaggtcggtacgggagggtaaccgggtacccgtaaaaggtccgggaacggtcccgtaccgttccggtaccctttaaccgtccgttacggtaccccgttcgggtacccgggggaccgttaacggggtacggtaccggttggtaccctaggttccccggttaccccg

SEQ ID NO: 283135 - DNA, 709 bp, Homo sapiens
  misc_feature: GYAE6OF01EX4G3.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcagggacgtcgggcccagggactgggtgaacgtcccgtttcgggaacgaccctcgccccctcacctggctagttgtcgtcctgggtcggcctccatccagctacggttggttacctttttactacgtaggttggtacgtcgtaccacggcccccgaaggggaacggacgtaaggacggtgggagtttgggagttagttccgatccgtaagtaagtcgggacgtaccttctaacgaccgtcccgtacctacgaacgacgccgagtcaccatacacgtaatacggactaacgtaccaacggtaacccaccgttcctacccctacgtaaccctacgtaccgtccgtcgttaaccgggtccgaccggtaaccgacgggttcccggtagttaactttcggttacgtcggtacgggtaacggggaaccgtaaaccgtaaagtcgggtacggacgttaccgtccggtacccgtttccacggttacgcccgtacgggtacggggaccgtaaggggtaccggtacggttgggaaccctggtacccggttacccg

SEQ ID NO: 283136 - DNA, 718 bp, Homo sapiens
  misc_feature: GYAE6OF01B12TY.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggacgtcgggcccaggactggtgaacgccttcggacgaccctcgcccctcacctgctattgtgtcgtgggcggctcgatcagctaggttggtttacttttactacgtaggttggacgtcgccgacgcccccggaaggggacgggacgtaggagtggtagttgggagttgtacagtcaagttaagtgggaacgtaccttacgtaaccgaccggtacccgttacccgtacaacggtacgaccgtaacgtaccaacctaacgtactaacgaagtacggaactacccgtaccgtaacggaaccctacccgtcctaaccccgttaccgtaaacctcctaacccgttcgttaacggttacccggacccgtaccggaccggaccggtaccggtttactaagtttacgtgggttacggacgggtaacgggtaacgtaacccgtaaaggttcgggtaccggtaccgtacgttcccggtacttcccgtaccgttacggtacccgttaccgggtcggggtaccgaacggggtacgtccggtaggtcgtacgtcccggttaccg

SEQ ID NO: 283137 - DNA, 648 bp, Homo sapiens
  misc_feature: GYAE6OF01ESLGY.52.39.D06.1.454.CMB.1.raw
  modified_base (400)..(400): a, c, t, g, unknown or other
  misc_feature (400)..(400): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtccgggcccaggactggtagaacgccgttcggacgaccccttgcccccttcaccgtgactattgtgtcgtgggtgctccatcagcagttggttacttttactactagttggagtcgccgacgacccccgaggggaacggactagtacggtggagttgggagtgttacatacagtaagtgggacgtaccttctacgacgcccgtcctacgaagacgccgacgtccacatanactaagtcgacgacgtaccgaacggaacctacctcctaccctacgtaaccctctaacctcgtacgttaccggccgacggtaccgaccggtccgttagttacttacgttggcggacgggtaacgggaccggtaaccgtaaaggttcgggtacggtaccgaccgttaccggtcccttacgtccgttacggacccgtccgggtaccggggccgaacggggacggttccgtaggtacctgtcccggttcccg

SEQ ID NO: 283138 - DNA, 728 bp, Homo sapiens
  misc_feature: GYAE6OF01CU84V.52.39.D06.1.454.CMB.1.raw
  modified_base (416)..(416): a, c, t, g, unknown or other
  misc_feature (416)..(416): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagcccttcggacacccctcgccccctacacctgctagtttgtgtcgtgggtcgcctccatcagctagttcggttacttttttacaacgtaggttggacgtcgccgacggccccccgaaggggaacggactagaggtggacgttgggagttgttcatcaagtaagtgggacgtacttactactaccgtcccgtcctacaacgtcgccgaagtcaaccatactactaanacggaaccacgtacccaacggaacccctacctacctccccgtacgtaaccctactaaccgttccgtacggttacccggcccggtaaccggacccgtaccgggtcccgttagttttaacgttggttcggtacggtacgggtaacggggacccggaacccgtaaaagggttcggggtacggacccgggtaacccttcccggttcccgtttaccgtaaccgttcccggtaacccggtttccgggtaccgggggaacccgggttacggggtaaccgggtcggttaccggtaccgttaacggttcccggttaccccg

SEQ ID NO: 283139 - DNA, 718 bp, Homo sapiens
  misc_feature: GYAE6OF01A95S6.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggacgtcgggcccaggactggtgaagccttacgggacgacccctgccccctcacctgctattgtgtcgtggtgcctccatcagcagttggtttaccttttactacgtagttggacgtccgccacgcccccgaaggggaagggactaggaggtggagttgggatgttacatactagtaagtgggacggtaccttacgtacacgtcccgtaccgtacaacggtacgaccgtagtaccaaccatactacaagtcggaacctaccggtaccgaacggaaccctacccgttcctaccccgttacgaaccctacctaaccgttccgttacggttacccggcccggacggtaaccgaccgggtaccgttacgttagtttacgttcggtacggacggtaccggggaaccgtaacccgtaaacggttgggtaccggaccggtaccgttccggtacccgtttaccgaacccggtttcggaacccggttcccgggtaccgggggaacccgtaacggggggtaacgtcccggttaagggttcccttaccggttccggttacccg

SEQ ID NO: 283140 - DNA, 680 bp, Homo sapiens
  misc_feature: GYAE6OF01EYDU2.52.39.D06.1.454.CMB.1.raw
  modified_base (256)..(256): a, c, t, g, unknown or other
  misc_feature (256)..(256): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcagggagtccgggccaaggactgggtgaacgtccgttcggacgtacccctcgccccctcaccctgcctattgtgtcgtggtgcctcatcagngtagttcgtttacttttactactggttgacgtccgccacggaccccgaggggaacggtacgtaggaggtggtagttgggtattggtcatacgtaagtaaggtggggacgtaccttacgaacgtaccggtccccgtccgtaacgaagacgccgacgtacacctatactacaagtcgaactacgacctaacggaccctacccgttctaccccgtacgaaccctacgtaaccttctaccggttaccgccggaccggacccgtaccgggtcccgtttagtacgtttagttcggtcggtacgggtacgggaacccgtaaccgtaaaggtcgggtacgacggttacgtaccgttaccttacggtacttccggtaccggtcggccggggaaggaccggggtaggttccgtaggttcgacgttccggtcccg

SEQ ID NO: 283141 - DNA, 788 bp, Homo sapiens
  misc_feature: GYAE6OF01ADX30.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcgagggacggtccgggaccaggactgggtagaacggtcccttacgggacgtacccctcgccccctcacctgctagttggtcgtcgtgggtcggtcctccatccgagtcgtacggtttacggtttaacctttttacacgtaggttgggacgtccgccgaccggacccccgaagggggaacggtacgtaaggtaggtcggtaggttggggtagttcgttacatacgtaagttaaggtcggggtaacgtaccgttaccgtaaccgtacccgtaccccgttacccgtaacgaacggaccggtaccgtaacgttacccaacctaagtactaacgtaacgtacggaaccgtaccggtacccgaaaccggtaacccctaccctcccgttaccccgtaacgtaacccctactaaccgttccgttaccgggttacccggcccggtaccggtaccgtaccgggtccgttagtttacgtttacggtggtacggacgggtaaccggggtaccgtaaccggtaaggttcggggtaacgaccgttaccgtccggtacccttaccggtaccgttccggtacccggtcgggtacgggtacccggaggggtaccgtcgttacggtcctcggttccgtcccg

SEQ ID NO: 283142 - DNA, 878 bp, Homo sapiens
  misc_feature: GYAE6OF01DQJ0I.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgttggttcttcctcctgctggtggcggctccagatgggtcctgtcccagctgcagctgcagggagtccgggcccaggacgtggtagaacgtcccgttacgggacgtacccctcgccccctacacctgactagttgtcgtcgtgggtcgcctccatcagtcgtagtttcggtttaactttttacgactaggttacggacgtccgacccgtaccggacccccggaagggggtaaacggtaaccgtagggtaggttagggtacggttaggggtagtttcggttactagtacgtaaagttaacgggtaggggtaaccgtacctttaccgtaaccggtacccggtacccccgttacccgtaacgaacggtaaccggtacccgaacgttacccaacctaacttaaccgtaacgtaacggtaaccggtaacccgtaaccggttaaccccgaaccggtaaacccccttaccccgtaccccgttacccctaaccgtaaaccccgttaccgtaacccgtttaccggtaccgggttaccccgggtaccccgggtaccccgggtaaccggtacccgggttaccgttaagtttacggtttaacgttacgggtacggtacggggtaacccggggtaaaccggtaacccgtaaagggttccgggtaacggtacccggttacccgtcccggttaccttaccgtacccgttaccggtacccggttcgggtaccggggtaccgggtaacggggtaacgttccggtaggttacccgtgttacccgttcccg

SEQ ID NO: 283143 - DNA, 830 bp, Homo sapiens
  misc_feature: GYAE6OF01EAB6D.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgttggttcttcctcctgctggtggcgctcccagagtggtcctcgtcccagctgcagctgcaggacgtccgggccaggactggtagaacgtccgttcggacgtaccccgtcgcccccttacaccctgtaccttagttgtcgttccgtggtcggtcctcctatcgagtcgttaagttcggtttaactttttactacgttagtaggtacgtccgaccgtaccgaccccggaaggggaacggacgtaagggtacggtggtaacgggttgggtaagtttcgtaccgtaagttacgtaaggttaaggtacgggtaaccgttacccgttaccgtaaccgtaccggtcccccgtaccgtaaccggaacgaaccggtaccgtaacgtacccaaacgtacgttaaacgtacgtaaacggtacggtaacccgtaaccggttaaccccgaaacccgtaaccccgtaccccgtttacccttaccccgttaaccgtaaaccttaccgtaaacccgtttcgttaccgggttacccgggacccgaccggtaccgtaccggtcgtttactttacggttagttacggaccggacggggtaaccggtaacgtaacccgtaagggtcggtaccggtaccctaccgttcccgtaacgtttaccgtaccggttaccgtacccggttaccgggaccgggtaacggacggggtaaccgtacgttgggtaccctggtcccgttaacccg

SEQ ID NO: 283144 - DNA, 838 bp, Homo sapiens
  misc_feature: GYAE6OF01A12ON.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcctcctcctgctggtcggccgctcccagtagtcgggtcctgtacccagctgcagctagcgaggacgtccgggaccaggctggacgaagtccgttcggactaccctcgtacccctacgacctggacttacgttgtcgtcgttcgggtacgtccttacaacgtcgaacgtcgtaacgttttacggttttaacctttttaacgaacggttacggttacgggaccgttccgaccccggtaaccggaacccccggaaggggtaaaccggtaacgttaggaggttaggtacggttagggtacttcgttacactaacgtaagttaggtacgggaacgttacccttagaaccgtccggtacccctacgagtaacggaccgtccggactaccacctaagtacctaacgtaacgtacggtaaaccctaccggtacgtaaacccggtaaccctaacccgttacccgttaaccccgtaaccaaaacccgttcccgtaaaccgtcccggtttacggaaccccgggtacccgaaacggtacccggtaaccggttaccggtttaaactttgttaacgtacgggtacggaaccgggaccgggtaaaccgacccgttaaaggggtcggtaacccggtccgttaacccgtacttacccgttaccgtacgtttcccgaaccggtttccgggacgggtaaccggacgggtaccgtgtacccggtagttacccgtcccggttaccgg

SEQ ID NO: 283145 - DNA, 732 bp, Homo sapiens
  misc_feature: GYAE6OF01EHYTY.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttccttccgctgctggtggcggctcccagagtcgggtcctcgtcccagctagcagctgcaggcgtccggccaggctggtgaacgtccgttacggacgacccgtcgcccctacgacctgctagtttgtacggtccgtgggttccgacctccaagtcgacgtcgtaacggttgttttaacctttttacgacggtaggttggacgtaccgccaccggccccggaagggaggtactaggtaggtgtaaggttgggtatgttcgatacgaataggtacgggtacgttaccttacgacggaccgtccccgttacaacggaacgccggacccggtatacccactactctaacaaacggtcggaaccctaccggtaccgtaaccgaacctccctacccttaccggtacctaaccctccgtacttcccgggttacgtaccggccgggtaccgaaccgttccgggacgttagttcgtttaacggttcggaggacgggaaccgggtacgaacccgttaaagggtgggtaaccgggcctaccggttccgaccctttacggtacccgttgggtaacccgtcccgggtacggggaacgtacggggtacgcgggttagtacctccgttccgtacccg

SEQ ID NO: 283146 - DNA, 942 bp, Homo sapiens
  misc_feature: GYAE6OF01BP1UF.52.39.D06.1.454.CMB.1.raw
tcagcgcagtacgacacgaccggtgctcgatttagtgacatctcgcagttctttggggatgctttctgagagtcatggacctcctgtgacaagaacatgaagcacctgtgttcttcctcctgctggtggcggctccagagtggtcctgtcccagctgcagctgcgaggaggtccgggacccgaggacgtcggtagaacgtcccgttacggaccgaccccttcggcccccttacgaccgtgctagttgtcgttcgtggtcgcctcatcacgtgtaggttagtttaccgttttacgaacgtggttggcgtacgtccgaccggtacccccggagggaacgggtactagggtacgtaggtagttagggtagttcgttacgaataccgttaaagttaaggtacggggttaaaccggttacccgtttacgtaaacccggacccgttacccccggttaaaccctaccggaacggtaaccggacccggtaacgtaacccgtaaacctacgttaactaaccgtaaacggttaccggaaccccgtaaccggtaaccgtaaaacccgggaaacccctaacccccgttttaaccccttaccccgtaaacccggtaaacccctttaacccgtaaaccttttacccggggtaccggtttaaccccggggcccggtaaccccggggtaacccgtccccggggttaaccgtttaccgggttttaacgtttccggtttaacggttaccgggtaacgggggtaaacgggtaacccgggtaaacccgttaaaaggggttccgggtaaccgggttaacccgtaccccggttttacccgtaaaccccttttcggttaacccggtttaccctcccggggttaaaccggttacccggggaaacgggttaacccgggtaacggggttaccggtaggtttaccccgtccggttacccggttcccccg

SEQ ID NO: 283147 - DNA, 864 bp, Homo sapiens
  misc_feature: GYAE6OF01BXOFP.52.39.D06.1.454.CMB.1.raw
tcagcgcagtacgacacgaccggtgctcgatttagtgacatctcgcagttctttggggatgctttctgagagtcatggacctcctgtgcaagaacatgaagcaccttgtggttcttcctcctgctggtggcgctccagatggtcctgtcccagctgcagctgcaggacgtccgggccaggtacgtggtagaacgtccgttcggactaccctgcccctcacctgctagttcgtgtcgtgggtcgcctcactcgagtcgtacggttacggttttacttttactaacgttaggttggacgtccgccgaccggtacccccggaaggggaacggtacgtaggacggtggtacggttgggtagtttcgtacagtacgtaaggttaacggtagggaacgttaccttacgtacgtaccggtaccccttaccgtacgtaacggacgtaccgtacgtacctaacgtaattaacgtacgtaaacgtaccgggaacctaaccggtaacccgtaaaccgggaacccccttaccccgttaccccgttaccccgtaaaccgtaaacccgttaacccttaaacccggttacccggtttaccgggtttaacccccgggaccccggtaccccgggtaaacccggtacccggggtttccggttttaaacgttaacggttttacggttaacggggttaccgggaacggggttaaccgggggaaccgttaaaaccccgggtaaggttccggggttacggacccgtacccgttacccggttacccgttaccggttacccgtttaccggaccgggttttaccgggccgggtaaccggtacggggttacggtccgttaccgggtacttaccggtcccgggtttaaccc

SEQ ID NO: 283148 - DNA, 711 bp, Homo sapiens
  misc_feature: GYAE6OF01DVAF1.52.39.D06.1.454.CMB.1.raw
  modified_base (375)..(375): a, c, t, g, unknown or other
  misc_feature (375)..(375): n is a, c, g, or t
tcagcgcagtacgacacgaccggtgctcgatttagtgacatctcgcagttctttggggatgctttctgagagtcatggacctcctgtgcaagaacatgaagcacctgtgttcttcctcctgcgtggtggcggctcccagagtcgggtcctgtcccagctgcagctgcgaggacgtccgggcccaggactggtgacgtccgttcggacgtaccctcgcccctcaccgtgctagtttgtcgtccgttggtcgcctccgtagtcacgcgtaggttcggtttaactttttaacgtagtagttggacgtccgaccgaccggcccccgaaggggaacgggacgtacggaggtagggtagttgggtagttcggttatagttnaaagtaggtacgggtaacgtaccttacgtaccaccgtaccccgttccgtacgaacgacgaccgtacgtacctaacctataactacaagtcgaccgtacgtaacccgacggtaacccctaccttcctacccctaagtaaccctacgtaaccgttcgtacggttaccgcccggacgtaccgaaccggtcgttacgttaagttcgtagtggacggtacgggactaaccgtaaggtcgggacgtccgacgttcccgttaccgttagtacccgttagcccggttacgggcgggtaacccgagggggtaactccggttacggtactcggttcccggtacccg

SEQ ID NO: 283149 - DNA, 749 bp, Homo sapiens
  misc_feature: GYAE6OF01DN65B.52.39.D06.1.454.CMB.1.raw
  modified_base (734)..(734): a, c, t, g, unknown or other
  misc_feature (734)..(734): n is a, c, g, or t
  modified_base (739)..(739): a, c, t, g, unknown or other
  misc_feature (739)..(739): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgcgtggtggcggctcccagagttgggtcctgtcccagctgcagctgcgagggacggtccgggcccaggacgtgggtagaacggtccgttacggacgtacccctcgccccctcacctgctattgtcgtcgtgggtcgcctccagtcagtccgtaggtttacgtttaacctttttacgaacgtaggttcggacgtcccgaccgaacccggacccccggaaggggaaacggtacgtaagggtacggttgggtaggtttaggggatttcgttacaagttacgtaaagttaacggtcggggtaacgttaccctttacgaccgtacccggtccccgtaccctaagaacgtacggacccgtacgtaccaccgtatacgtaacgtacgtacggaccctaaccgtaccgaaccggtaaccctaccgttccctaccccgtaccgaaaccttcctaccgttcgttaccggtacccggcccggtaccggtaccgtaccggttacccggttagtttacgtttaacgttgggacgggaacgggtacgggaccgtaaccgtaaggttcggacgaccgtactccgtcttacgaccttcggaccgtcgggccgggacgagggtcgtacgngtacngttccgtccg

SEQ ID NO: 283150 - DNA, 847 bp, Homo sapiens
  misc_feature: GYAE6OF01BW805.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtcggttcttcctctgcgtggtggcggctcccagagtgggtcctgtcccagctgcagctgcgaggacgtccgggacccagggacgtgggtaggaacgtccgttaccggacgacccgtccgccccttcacctgactagttgtcgtcgttgggtcgtcctaccagtcgagtctaggtttcggtttaacctttttactaggtaggttacggtacgtccgaccgtaccggacccccggaaggggaaggaccggtaggtaggtagggtacggttagggtaggttacgttacgtaacgtacgtaagttaaaggtcggggtaacgttacccgtttacgtaacccgaccggtaccccgtaccgtaacgtaacggtaaccgccggtaacgaacccgtaaccgtattaacgtactaaaacggtcggaacccttaaccgtaaccgtaacccggaaccccttacctaccccgtaccctaaccgttacccgtaacctaaaccgttccgttaacgggtacccgggaccccgggtaccggtacccggtacccgggttacgttacggtttaacgtttacgttcgggttacggaccggggttaaccgggtaaccggtaacccggtaaaggttcggggtccgaccggtacccgtttccgacccgtttaccgtccgttacgggtaccgggttccgggtacgggtaaccgggaacggggttaacgtcccgggtttaggacttaccgttccggttacccccg

SEQ ID NO: 283151 - DNA, 788 bp, Homo sapiens
  misc_feature: GYAE6OF01BUSS2.52.39.D06.1.454.CMB.1.raw
tcagcgcagtacgacacgaccggtgctcgatttagtgacatctcgcagttctttgggggatgctttctgagagtcatggacctcctgtgcaagaacatgaagcacctgtggttccttcctcctgcgtgggtggcggcctcccagtagtcgggtcctcgtcccagctgcagctgcgagggacggtccgggcccgaggtccgtgggtacgaacggtcccgttaccggggacctacccgtccgaccccctacgacctgcttagttcgtcggtccgtgggtacgcctacctatcgagtcgtacggtttacgttttaaccttttacgtacgtaggttcggacgtcccgaccgtaccggaccccggaaggggaacggtacgaggtagggtaggtagggttgggtacgttgtacgtaatacgtaagttacgggtacgggtaaccgttaccttacgacctcccggtcccgtaccgtaacggaacgcgaccgtacaccactatacacgacgtacgaccgtacgaccgaacgtaccctcctacccgtaccctacgtaacccttactaccggttccgtacgggttaccccggcgtaacccggaccggtaccggttacgttacgtttagttccggtagggtaccgggaacggggtaacggtaccggaacccgttaaggggtcggtccggtaccgggttcccgttccgtacccgtttaccggtccgttcccggtacgggtcccgggtacggggacccggttaagggggtaccttcggtacgtccgttccgtccgttacccg

SEQ ID NO: 283152 - DNA, 903 bp, Homo sapiens
  misc_feature: GYAE6OF01AOUDG.52.39.D06.1.454.CMB.1.raw
tcagcgcagtacgacacgaccggtgctcgatttagtgacatctcgcagttctttggggatgctttctgagagtcagtggacctccgtgtcgcaagaacatgaagcacctgtggttcctcctcctgctggtggcgctcccgagatcgggtcctgtcccaggctgcgagctcggcgagggacgtccgggcccgtagggactgggtaggaacgtcccgtttacggggacctaccccgtgtcccccttacgacctgtcttagttcgtcgtcgttggtcggtcctaccagtccagtcgacgtttcggtttaaccgttttacacggttagttcggtacggtacgtacccgtaccggacccccggtaagggaacgggtaacctaggtacggtaggtaagtttacgggacgttacggttaccaacgtaccgtaagttaaccggttagggtaaccggtttacccgttacgttaaacccggtaccggttaccccccgggttaaccgtaaccgtaaacgggacccgtacccggtaaattacccgtaaacccgtaaccttacgtaaacctaacgggtacccggtaaccgtaacccggtaccggaaaccggttaaccccaacccgtttccccgtaaacccgtacggttaaacccctacgtaaacccgttccgtaaaccggttacccggggacccgaaaccggtaccgtaccgggttacccgttacggttaccggttaacgtttacgggccgggtaacgggaaccggggtacccgtaaccggtaacggttacggggtcggtaacccgtaccggtcgtacccgtttccgtacggttacccgtccggtacggtacccggggtaccgggtaaagggttcccggacggtttaaccggacgttaccgggttcccgtaccccg

SEQ ID NO: 283153 - DNA, 772 bp, Homo sapiens
  misc_feature: GYAE6OF01A5CKF.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgttcggttcttcctcctgcgtggtggcggcctcccagtagtcgggtccttcgtcccagctgcagctgcgagggacgtccgggcccaggcgtggtagacgtccttcggacgccctccgcccctacgacctgtctagttcggttcgtcgtggtagcctaccgatccgacgtacgtaggtttacggtttacctttttacgtacgtagttaggacgtccgacccgacccggacccccgaaggggaacggtacgtaggtaggtcggtagttgggtagttcgttacgagtactaagttaggtagggtacgtaccgtttcgtaccgtccgtaccccgtacctacgaacgtaccgaccgtaacaccgtaacccgtagttaaccgtaaccgtaaagtccgggtaaccgaaccggtaaccgaaacccggaacccctacccgttccctacccgtaaccgtaaccctactacccgttacggtacccggtaccggtcccggacggtacccgtacgggttcccgttaagtttctttcggttaggccggtaagggaccgggtaacgaccgtaaggtggtacccggacgtacccgtcgttacccgttacgcggttcctcggttcgggtacggggaccggtaacgggtcggttaccggttagccggtttccgtcccgttaccg

SEQ ID NO: 283154 - DNA, 169 bp, Homo sapiens
  misc_feature: GYAE6OF02JEZCS.52.39.D06.1.454.CMB.1.raw
  modified_base (164)..(169): a, c, t, g, unknown or other
  misc_feature (164)..(169): n is a, c, g, or t
tcagcgcagtacgatcagatggcggcacgaccggtgctcgatttagtgacatctcgcagttctttggccgaccgggctgattatcgagctctccgcgagagagctcgactaaatcgagcaccggtcgtgtgtatacgcgctgatggcgcgagggagcgatacgnnnnnn

SEQ ID NO: 283155 - DNA, 533 bp, Homo sapiens
  misc_feature: GYAE6OF02G8RX4.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtcctcaagagccgagtcaccatatcaatgacacgtccaggaaccacctctccctcgaacctcaactctgttacggccgcggacacggccgtgtattagttgtgcgagggacggacccaaaagtcggtaggcgacgtccgccttccgacttcgaccgtcgtcggggccagggacggcgtgggtcagtcgtccg

SEQ ID NO: 283156 - DNA, 516 bp, Homo sapiens
  misc_feature: GYAE6OF02FZ4PL.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggagaccttctacagcccgtccctcaagagccgagtcaccatatcaatgacacgtccaggaaccacctctaccctgaaccctcaacctctacgttacggccgcggacacggccgtgtattatgtgcgagggagcccaaaatggtgcgactcgcttcgacttgacctcgtgggccagggacggctggtcatcgtcc

SEQ ID NO: 283157 - DNA, 656 bp, Homo sapiens
  misc_feature: GYAE6OF02H45MH.52.39.D06.1.454.CMB.1.raw
  modified_base (212)..(212): a, c, t, g, unknown or other
  misc_feature (212)..(212): n is a, c, g, or t
tcagcgcagtacgacacgaccggtgctcgatttagtgacatctcgcgagttctttggggatgctttctgagagtcatggacctcctgtgcaagaacatgaagcacctgtggttcttcctcctgctggtggcggctcccagatgggtcctgtcccagctgcagctgcaggagtcgggcccaggctggtgaagccttcggagaccctgcccctnacctgcattgtgtctggtcgctaccatcagcagtggtacttttactacagttggagtcgccagcccccagggaagggactagagttggatttgggagtgttcagtcaagtaaatgggaaggaccttctacacggccctccctacaagacgaccgaggtaccaaccatactcaaatcggaactaccgtaccgaacggaacccaccctaccctacccgttacaaaccgttaccaactcttacggttaaccggccgtaccggaccaaccgggtccgtaggttaaactttcgtttacggcgtacgggaaaccggggtacggaaacccgaaaacggttggtacgggtaccgtaccgtaccggtcccgtttaccgacctttacggtccccttaccggtacggggtacccaaggggaaccggtcctaggggtcctacgttccggttccccg

SEQ ID NO: 283158 - DNA, 577 bp, Homo sapiens
  misc_feature: GYAE6OF02H6BZ5.52.39.D06.1.454.CMB.1.raw
  modified_base (212)..(212): a, c, t, g, unknown or other
  misc_feature (212)..(212): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctnacctgcattgtgtctggtgctccatcagcagtggttactttttactacagttggagtcgccagcccccagggaacgggactaggagtggagttgggagtgttcatcattaatgggaggtaccttactacacgcccgtccctacgagacgccgagtccaaccatatcaatcggactacgtccaacggaacccacctcctaccctacgaaccctacacttctacgttaccggaccgtcggaccacgggccgtagttattagttgtgacggagggacggtacccgtaaaagtgggtacgcgtactcgtccttcgacgttacgaccgttcgtcggggccgtagggtacggcgtggtctacgtgttcccg

SEQ ID NO: 283159 - DNA, 551 bp, Homo sapiens
  misc_feature: GYAE6OF02ID5O4.52.39.D06.1.454.CMB.1.raw
  modified_base (483)..(483): a, c, t, g, unknown or other
  misc_feature (483)..(483): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctccatcagcagtggttactttttactacgagttggagtcgccaggcccccagggaagggactagagtggagttgggagtgttcatcataagtgggagtaccttctaacacgtcccgtcctcaagcgaccgagtcaccatactcaatcgacacgtccaacggaccacctcctccctacgaacctcaactctacgttaccgccgcgaccacggccgtagtattagtgtgacggagggacgacccaaagtcggnggcgacgtcgtccttcgtacttcgaccgtcgtcgggaccgtaggggacgcgtcggtctacgtcgtccg

SEQ ID NO: 283160 - DNA, 694 bp, Homo sapiens
  misc_feature: GYAE6OF02JMMSD.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggctggtgaagccttcggagaccctgcccctcacctgcattgtgtctggtggctccatcagcagtggttacttttactacagttggagtcgccacgcccccgagggaagggactacgagtaggattgggatgttcatctacgtaagtgggacgtaccttcacacgcccggtcctacaagcgccgtaagtcaccagtactacgaacgtggactacgtccgaaggaaccctacctccgtacccgtacgtaaaccctccgtaaaccttccgttacggtttacccggacccgttacggacccgtaaaccgggtcccggttaacgttaacgtttaacgtttcggtaccgggtaccggaacgggggtaaccggacccgtaaaaacgggttcgggttaaccggacgggtaacccttcgggtaccctttaaccggtaccgttttacgaaccggttccggtacggggtacccgtaagggggtaaccggtccgttcgggtaccgtaaccgttcccggtttccccg

SEQ ID NO: 283161 - DNA, 600 bp, Homo sapiens
  misc_feature: GYAE6OF02H4MXC.52.39.D06.1.454.CMB.1.raw
  modified_base (346)..(346): a, c, t, g, unknown or other
  misc_feature (346)..(346): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcggcccaggactggtgaagccttcggagaccctcgccctcacctgcattgtgctggtggctccatcagcagtggttacttttactacagttggtagtcgtccacgtccccgaagggaaggactagaggtggagttgggagtgttactatcaagtaatggggaggtaccttctacncgtcccgtcctacgaacgagccgacgtcaaccattactacaagtcggactacgtaccgaacggtaacccacccttccaccctagaaccctaccaacttccgttacgttaccggccgtacggacctacgggtaccgtacgtatttacgtagtcgacggaacgggacgtaccgaaagttggacggtcgactcgcctttacgacttcgacgtcggtacgggaccgtagggacggtcgtacggtcgtactcggtcccg

SEQ ID NO: 283162 - DNA, 616 bp, Homo sapiens
  misc_feature: GYAE6OF02GEXTI.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagttggttactttttactactagttggagtcgcctacgcccccgaagggaacgggactaggacgtggattgggagtgttcatcataagtgggaggtaccttctacagcccgtcctacaagtacgccgagtcaccatatcaagtggacaccgtaccacggaacctcctcctaccctacgaccctacaacctcctcgttacggccgacggaccgacgggtcccgtagtacttacgttgtcggacgtacggggtacgacccgtaaaggtcggtacggacggtacctccgacctttccggaaccgtttagacccgttcggtaccggggaccgtaacggggtaacgggtccgttacgggtcgtacgtcccggttacccg

SEQ ID NO: 283163 - DNA, 606 bp, Homo sapiens
  misc_feature: GYAE6OF02H186O.52.39.D06.1.454.CMB.1.raw
  modified_base (368)..(368): a, c, t, g, unknown or other
  misc_feature (368)..(368): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtccgggcccaggactggtgaagccttcggagacccctgcccctcacctgcattgtgtctggtcggctccatcagcagtggtacttttatacagttggagtcgccacgcccccgaagggtaaggacctagagtggtatggagtgttcatcataaagtgggacggtaccttataaccaggtcccgtcccgtacaaggacnccgtagtcaaccatacgtcaagtcggactacgtccaacggaaacccacctcctacccgtactaacccgtacaaccttcgacgttaccggcccggacgaccgtaccggccgtagtttacttaattggtcgacgggaagggtacgaaccaaaaggtcggtagccgactaccgtccttacgaactcgtacctcggtacggggtccaacggggtaggccgttaggtctacgtcggttacccg

SEQ ID NO: 283164 - DNA, 615 bp, Homo sapiens
  misc_feature: GYAE6OF02GB8IK.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaacgccttcggagaccctgcccctcacctgcattgtgtcgtggtgcctccatcagcagttggttactttttactactagttggagtcgccacgcccccgaggggaacggactaggagtaggagttgggagtgttcatcaataagtggacgtaccttctacacgcccgtcctcgaagacgccgagtcaacatatacaagtgacacgtaccgaacgaacccacctcctaccctacgaaccctaccaaccttcctaggttacccggccgaccggaccgaccggtcgttgttattgtgtcgacggaagggtacggaaccctaaaggtcggacggtacgtaccgtcgtaccttaccgtaacgtttaccgtacccgttcggtcggggaccgtaggggaacggtccgttacgggtacgtacgtttcggtacccg

SEQ ID NO: 283165 - DNA, 701 bp, Homo sapiens
  misc_feature: GYAE6OF02JRF2D.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttggacgaccctgcccctcacctgcattgtgtcgtggtcgcttccatcagctagttcggttaccttttactacgtagttggacgtcgaccgacgtccccgaagggaacgggactaggaggtggtagttggggtagtgttacagtacaagtaagtagggtagtaccttacgtacgacgtcccgtacctacgaacggcgaccgacgtacaactatactacaacgtacggaccaccggtaccgaacggaaccctaccctccctacccgtaccgtaaccctaccgtaaccttccgtacggttaacccggccggaccggtaccggtaccggtaccggtacgtttaacgttagttacggtcgggaccgggtacgggtaaccgggtaaccgtaaaagggtcggtaacgggtaccgtaccgttaccgtacccgtttacgacccgtttacgacccgttcgggtaccgggtaccggacggggtaaccggtcggttacggtctacggttccgttacccg

SEQ ID NO: 283166 - DNA, 547 bp, Homo sapiens
  misc_feature: GYAE6OF02FP0ZA.52.39.D06.1.454.CMB.1.raw
  modified_base (397)..(397): a, c, t, g, unknown or other
  misc_feature (397)..(397): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagacttcggagaccctgccccctcacctgcattgtgtctggtgctccatcagcagtggtactttttacacagttggagtcgcctacgcccccaggggaagggactaggagtggattgggagtgttcatcatatgggagtaccttctacacgcccgtcctacaagacgaccgagtccaaccatactcaatgacacgtaccaggaacccnctctccctagaccctcactctggttaccgccgacgacacggccgtgtattgtgtgcgagggacgaccgaaagtcgggtagacgacgtcgccttcgtacgttcgacctcggtcgggccgtaggggacggtcgtggtacgagttcgttcccg

SEQ ID NO: 283167 - DNA, 572 bp, Homo sapiens
  misc_feature: GYAE6OF02HK97N.52.39.D06.1.454.CMB.1.raw
  modified_base (363)..(363): a, c, t, g, unknown or other
  misc_feature (363)..(363): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgctattgtgtctgggtggctccatcagcagtggttactttttactacgtagttggagtcgccacggcccccgagggaaagggacctagaggtggagttgggagtgttcatcagtaagtgggtacggaccttctacacgccgtccctnaacgagccgagtcaccatactacaagtgacacgtccacgaaccacctctaccctagaacctacaactctacgttacggccgcggacgacggctagtattacgttgtggcgagggacgaccgaaagtcggaggcgactcgtaccttcgtacgttcgtaccgtcgtcgggtaccgacggggtaacgtccgttgggtactacgtcgttcccg

SEQ ID NO: 283168 - DNA, 548 bp, Homo sapiens
  misc_feature: GYAE6OF02GPU3Y.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctccatcagcagtggtacttttactactagttggagtcgccacgccccaggggaacgggactaggagtggagttggggagtgttcatcataagtgggagaccttctacacgcccgtcctcaagcgcgagtcaccatatcaatggacacgtaccaggaaccacctctccctagaaccctcaacctctagttaccggccgcggaccgacggtccgtagtacttagttgtcgcggagggacgacccgtaaagtcggtagcgtactcgccgttcacttcgcctcggtcgggaccgagggacggtctcggtctagtcgtccg

SEQ ID NO: 283169 - DNA, 698 bp, Homo sapiens
  misc_feature: GYAE6OF02GDEFW.52.39.D06.1.454.CMB.1.raw
  modified_base (213)..(213): a, c, t, g, unknown or other
  misc_feature (213)..(213): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtccgggcccaggactggtgaagccttcggagaccctgcccctnacctgctattgtgtctggtggctcatcagcagttggttactttttacacgtaggttggacgtcgccacggcccccgaaggggaacgggactaaggaggtgggtagttggggagttgtttcattacaagttaaggtggggaggtaccttacgtacgtacgtccccgttaccctacgaacggacgccgaacgtccaacctattaactactaacgtcggaacaccgtaccgaacggaaaccctaccctccgtacccctacgtaaacccttcctaaaccttccgttacggttaaccggcccggaccggaccgtaccggtaccgttacgttaatttacggttacggtcgtacgggaacggggtacgaacccgtaaaaggtcgggtaggaccgtacgtccggtcctttaccgtaccgttacgtacccggttccggttacggggtacccgtaacggggtacgtccggttgggtcgtacgtcccggttacccg

SEQ ID NO: 283170 - DNA, 656 bp, Homo sapiens
  misc_feature: GYAE6OF02HMT8L.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctccatcagcagtggttacttttacacagttggagtcgccagccccagggaacggctagagtggattgggagtgttcattcataagtgggacggaccttcgtacacgtcccgtccctacgaacgacgccgagtccaacctatactacaattcggaacaccgtaccaacggtaacccacctccttacccctacgaacccttactaacctctacggtttaccggacccgtccgggtaacgacccggtaccgttagttaactttacttacggttgaccgggacgggtacggaacccgtaaaaagttcgggtagggtacccgtacgtacccgttccgttaccgtaccgtttaccgacccgttccggttaccgggggaccgtacgggggaaccgggtccgtacggggttcctacggttcccggttacccg

SEQ ID NO: 283171 - DNA, 665 bp, Homo sapiens
  misc_feature: GYAE6OF02GC1D7.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgcccctcacctgcctattgtgtctggtgctccatcagcagtggttacttttactactagttggagtcgaccacggccccgagggaacgggacctaaggacgtggtattggggagttgttacatacaagtaagtgggacgtaccttctaacgtacgtcccgtccctacgaacgacgccgaacgtaccaaccgatacttacaaagtcggacgtaccgtaccgaacggtaaaccctaccttccgtaccctacgaaacccttacaaccgttaccgtacggttaaccggaccccggacgggtaccgtaaccgggtcccgttaggttaacgttacgttacggtcggtacggaacggggaacggtaacccgtaaaagtcggttagggacctaccgtcgtcccgttacgtcgttacgtacccgtcgtacgggaccgtaggggaccgcgtggaccgtagtccgttccg

SEQ ID NO: 283172 - DNA, 806 bp, Homo sapiens
  misc_feature: GYAE6OF02HJJUG.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtccgggcccaggactgggtgaacgtccgttcgggacgaccccgtcgcccctcacctcgctattgtgtctggtcgctccatcagcagtggttactttttactactagttggacgtcgccacgacccccgaggggaacgggacgtagaggttgggacgttggggtagttgtttcagttacaattaagtggggtaacggtaccgtttctaccgtacgtaccccgtccgtacgaaacggacgaccggtacgtaccgaacctaatactaccgtaagtacggaccgtaacgtacccgaacgggtaaacccctaccccgttaaccccgtaccccgtaaccgtaaccccttaacctaaccgttcccgttaccgggttaccggtacccgggacccgggtaaccggacccggggttccgtttacggtttaaacgtttcggttacgggtcgggtaaccggggtaacggggtaacccggtaaaacccggttaaagggttaccggggaaccggtaccgggttacccgtcccggtttaaccgttacccggttaccgtaaccggtttacccgggttccgggttacccggggtaacggtaccgggggtaacgtcgggttaaccggtcggtttaccgtttcccgggttacccc

SEQ ID NO: 283173 - DNA, 984 bp, Homo sapiens
  misc_feature: GYAE6OF02GQ9JB.52.39.D06.1.454.CMB.1.raw
tcagcgcagtacgacacgaccggtgctcgatttagtgacatctcgcagttctttggggatgctttctgagagtcatggaccctcctgtgacaagaacatgaagcacctgtgttcttcctctgctggtggcggcctcccagtagtcgggtcctcgtcccagctgcagtctgcgagggtacggtccgggacccgaggtacgttgggtacgaacgtcccgttacgggaccgtaccccgtccggccccctactacctgactagtttcggtcgttccgtgggtcgcctccatccgagctaggttcggtttaacctttttactaacgtaggtttcgggtacgttccgacccgaccggtaccccccggaagggggtaaacgggtactaacgggtaggttagggtaacggtttgggggaagtttggttacctaagttaccgtaaagtttaacggtacggggggtaacggttaacccctttaccgtaaaccgtacccggtacccccggtttacccctaacggtaaaacggacccgggtaccccggtaacggttacccctaaacccggtaaatttaaccgttaaaccgtaaacggttaccgggtaaacccgtaacccgggttaacccgtaaacccggggtaaaacccccttaccccgttacccttacccccggttaaaccggttaaacccccttaacccgttaaaacccgtttcccggtttaaccgggtttaaccccgggaccccggttaaccggggaaaccccgtaaccggggtcccgttttaaaggtttaacttttaacggtttcgggtacggtaccggggtaacgggggtaaccggtaaacccgttaaaagggtcggggttaccggtaaccgtcccgttaccggtaccctttaccggttaaccgttaccggtacccggttcgggttaccgggggaccggaacgggggttacggtccggttacgggtaaccttacggttcccgttaccccgg

SEQ ID NO: 283174 - DNA, 694 bp, Homo sapiens
  misc_feature: GYAE6OF02H1USZ.52.39.D06.1.454.CMB.1.raw
  modified_base (237)..(237): a, c, t, g, unknown or other
  misc_feature (237)..(237): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtagaacgccttcggacgaccctcgcccctcacctgctattcgtgtcgtggngctcatcagctaggtcgttacttttactacgtagtggagtccgcgacgccccgaagggaaggactaggagtggagttggggagtgttacagtacagtaagtgggacgtaccttctacgccgtacccgtcctacgaacgacgaccgacgtcaacctaatacgtactaagtacggacctaccgtaccgaaacggaaccctacccgtaccgtcccctaacggtaaaccctcgtaaccctcgttacggttacccggcccggtaccggtaccgaccgggtaccgttagttacgttacgtttaggaccggacgggtaacgggtacgaaacccgttaaaggtcggggtcgtaaccgtccgtaccgttaccctttccggaactttcccggtacccgttacgggtacggggacccggtaaacggggttacggtcccggttaggtccgtaccggttacgttcccccg

SEQ ID NO: 283175 - DNA, 555 bp, Homo sapiens
  misc_feature: GYAE6OF02HFQK7.52.39.D06.1.454.CMB.1.raw
  modified_base (485)..(485): a, c, t, g, unknown or other
  misc_feature (485)..(485): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctccatcagcagtggtacttttactactagttggagttcgccagcccccgagggaagggacgtaggagtggagtgggagtgttacatcaagtagtggggaggaccttcgtacacgtccccgtcctacaacggtacgccgagtacaccatatcaatgacacgtcaaggaacccactctccctagaacctcaactctagttaccggccgcgaccacggtcctgtattcgttgcgcggaggacgaccgaaagtcggnggaccgacgtcgtcctcgtcgttacgaccctcgtcgggaccgagggacggcgtggtcaggttcgtacccg

SEQ ID NO: 283176 - DNA, 770 bp, Homo sapiens
  misc_feature: GYAE6OF02GI81Y.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctgggtggcggctcccagagtgggtcctgtcccagctgcagtctgcgagggacggtccgggccccgaggtacgtgggtgaacgcccgttacgggacgacccctcgccccctcacccgtcgctagttcggttgtccgtgggtcggcctaccactcgagctaggttacggtttacttttactacgtaggttcggacgtccgaccgaccgcccccggtaaggggaacgggtacgtaaggaggtaggtagttgggtaagttgtcatcaagtaaggtggacggtaccttcctacgaccgtccccgtcctacgaacggacgaccgacgaccactaatactactacgtaggaccaccggtaccgaacggtaaccctacccgtaccctacccgtacgtaaccctaccgtaaccgttccgttaccgttacccgggacccggtacccggtaccgtacccgggtaccgttacggttaacttttacggtacggttcgggacgggtaacggggtaaccggtaacccgttaaaggtcggggtaaccggtccggttaccctccgtacccgtttccgtaaccgtttaccgggaccccggttccgggttaccggggacccggtaaggggtccggtaccggttacgggtctaccggtccgttaccg

SEQ ID NO: 283177 - DNA, 721 bp, Homo sapiens
  misc_feature: GYAE6OF02HZZJ0.52.39.D06.1.454.CMB.1.raw
  modified_base (263)..(263): a, c, t, g, unknown or other
  misc_feature (263)..(263): n is a, c, g, or t
  modified_base (394)..(394): a, c, t, g, unknown or other
  misc_feature (394)..(394): n is a, c, g, or t
  modified_base (536)..(536): a, c, t, g, unknown or other
  misc_feature (536)..(536): n is a, c, g, or t
  modified_base (600)..(600): a, c, t, g, unknown or other
  misc_feature (600)..(600): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcggcccaggactgggtagaacgtccgttcgggacgacccccgtccgtcccactaccgtcgacttgttcggtcgtcggtgggtcgtctcctancgagtacgttaggttacgttttaacttttacgtaacgttaggttacggtacgtccgacccgacccggaccccggaaggggacggtacgtaggtaggtaggtagtggtagttcgtactatacgaagttaggnggtacgtccttacgacgtacccgccccgttacgaagacgtaccgacgtacgacctaacgtaattacgtaacgtaagaccggtaaccttaccgaaccggtaacgtaacccctaccctcccttaacgtacccgtaaaacccttntaacccttcggtttaccggacccggaccgtacggaccgtaccgggtccgttagttaatttccgngggtaacggcgggaaacgggtacccgaaaagttacggggtacgacgggaacctccggtacctcgttaccgcgttacgccgtagggtccgggacggtaggcgtcgttcggatccgtctcccg

SEQ ID NO: 283178 - DNA, 963 bp, Homo sapiens
  misc_feature: GYAE6OF02IBS2M.52.39.D06.1.454.CMB.1.raw
tcagcgcagtacgacacgaccggtgctcgatttagtgacatctcgcgagttctttggggatgctttctgagagtcatggacctcctgtgcaagaacatgaagcacctgtcggttcttcctcctgctggtggcggctcccgagagtcgggtcctgtcccagctgcagctgcaggagtcgggctcgaggactgggtacgaacgcccgtttacggacacccctgcccccttcacctgcagttcgtacgtctggtgcctccatcgagcagtcgttacgttttacacgtagttggacgttcgacccgtacgaccccgaagggggtaacgggtaaccgtaggtaacggtcgggtaggtttacggggagttcggttacacgttacgtaagttaacggcggggtaacggtacctttaccgtaaccggtaccggtacccccggttacccctaagtaaacgggtaccggtaacccggtacgttaccgaaacccgtaacttaacgtaaccgtaaaacgttaccgggtaaacccgtaaccccggttaaacccgaaacccggggttaaaaccccctaacccggttacccgttaaccccgtaaaccggttaaaacccttacccggtaaaacccgtttaccgggttaaaccggttttaaccccggggaccccgggtttaaacccgggaaccccgttaacccggggttacccggtttaaacggtttaaaccggtttttacggttaacgggtttccgggaaacccggggttaacgggggaaacccggggtttaaacccccgaaaaaggggtttccgggggttaacccgggacccgttaacccgggtttccccggttaacccggtttaacccggttaacggttttacccggaacccggtttccgggtaaccgggggttaccccggaaacgggggtttaccgtacccggggttacggttaaccctccgggtttaaccccggg

SEQ ID NO: 283179 - DNA, 860 bp, Homo sapiens
  misc_feature: GYAE6OF02JW6JD.52.39.D06.1.454.CMB.1.raw
  modified_base (166)..(166): a, c, t, g, unknown or other
  misc_feature (166)..(166): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgcgtggtgggcggctcccagagtcgggtcctagtcccagctgacngctgcgaggagtccgggcccaggacgtggtagaacgtccttgggacgacccctcgcccctcacctgcctagtttggtcgtcggttgggtcggccttacccagttcacggcctaaggttcggtttaacctttttactacgtaggttacggagtccgtccgaccgacccccggaaggggtaagggactagggagtacgggtagttaggggtagtcggtttacgaattcgaaagttaaggtcggggtaacggtaacctttcgaaccggtaccggtcccccggtaccctacgtaaacgggcccggacgtaccgttaccaccgtaaactactaccgtaaagacggttacccgaaccgttaccggaaccgtaaaccctacccgtccttaccccgtacggtaaaccctaccgtaacccgttacgttaccgggttaaccccggtacccgggaccggtaacccgggtacccgggttaccggtttacgtaaacggttttaaccgttcggggttacccggtaccggggtaaacggggttacccgggaaacccgttaaagggtaaccgggtcggtaaccgtacccggtcccgtttaccggttacccgttacggttacccggttacccggtccggggttaacgggttaccgggaaccgggttaccgggtaccgttacggttacccggttacggtcccggtttacccg

SEQ ID NO: 283180 - DNA, 928 bp, Homo sapiens
  misc_feature: GYAE6OF02F52KR.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgtctggtggcggctcccagatcgggtcctgtcccagctgcagctgcaggacgtccgggcccaggactggtgaacgtccgttacgggacgacccctcgcccctcaccgtgactagttgtcgtcgtgggtcggtcctcctatcgagcctagttaggttaacctttttactacgtaggtttcggtacgttccggacccaccggaccccccggaaggggtaacggggaccgttaacggacggttaggggtaaggtttagggggacgtttgggtttaccaagttccgtaaaggttaaacgggttcggggggtaacgttaaacccgtttacctaaccggtaaccggttcccccggttaaacccctaccgggtaaaacggtacccggtacccggttaacggtaaccccgtaacccttaacggtaacccgttaacggtaaaaccggttaccggggtaaacctaaccccgggtaacccgttaaacccgggaaaacccccctacccgtttaccccgttaacccccgttaacccggtaaacccttaaccccgtaacccgttttacccgttaccggggtttaacccccggaccccgggttacccgggaaccccgggttaaccccgggtccggtttaacggttttaaccgttttacggttaccgggttcgtaaccggggacggggtaacccggtaaacccgttaaaacgggtcggtaaccgggtaccgtacccggttccgtccttcccgtacggttccggttactcccggtacgggccgtaacggggtccggtcgtcgggtaccgtactccggttacccg

SEQ ID NO: 283181 - DNA, 846 bp, Homo sapiens
  misc_feature: GYAE6OF02GKHG8.52.39.D06.1.454.CMB.1.raw
  modified_base (227)..(227): a, c, t, g, unknown or other
  misc_feature (227)..(227): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtccgggcccaggactggtgaacgtccgttacggacgacccttcgccccctcaccgtncctattgtcgttcgtgggtcgctccatcagcgtaggttaggtttacctttttaacgtaccgtaggttggtaacggttccgccgaccggtccccccggaagggggaaacgggtacgtaggtaggtagggtacgttaggggtaggtttcggtttactacgttaccgaagtttaaacgggtagggggtaacggttaccctttaccgttaacccggccggtacccccggtttaccctaaccgtaaacggacccggtacccggaacggtttacccaaaccgtaagttaactacgtaaaccggtacggtaacccgtaaccgttaacccgaaacggtaaaccccctacccttccccgtaaccctaccgtaaaccctacctaaccgttaccgttacgggttaacccggccccggtacggaaacccgtccggggtaccgttttaaggttacgttttaaggtaccggtcgggtaacgggacggggtaacccggtaaccgtaaaagggttccgggacggacccggttaccgtcccggttaccttaaccgcccggtttaaccgtcccggttcggtaccgggaccgggtaacggcgggtacgtttcgggaccgttaccgttcccgttacccg

SEQ ID NO: 283182 - DNA, 759 bp, Homo sapiens
  misc_feature: GYAE6OF02GMWI2.52.39.D06.1.454.CMB.1.raw
  modified_base (444)..(444): a, c, t, g, unknown or other
  misc_feature (444)..(444): n is a, c, g, or t
tcagcgcagtacgacacgaccggtgctcgatttagtgacatctcgcagttctttggggatgctttctgagagtcatggacctcctgtgcaagaacatgaagcactgtggttcttcctctgcgtggtggcgctccagatgggtcctgtcccagtccgtgacagctgcgaggacgtccggcccaggtctggtagaacgtccgttcggaacgcccctgcccctctacctgctacgttcgtgtcgtggtcggcctaccgatccgaggtctacggtttcgttaacctttttaccgacgttaggtacggtcgtccgacccgtaccggaccccgggtaaggaacgggactaggtaccggttgggtacggttgggtacgttcgttcaagtacgtaacgtagggtagggtaccggttacttacgtaccgaccggttcccctcgaacgtaacgnggtacccgtacgtaccgacttaacgtagtacctaaggtcgaacccgacggttacccggaacggtaaccctaccccttcccgtaactaccgaaccgtaacctacctccggtttaaggccccggtccgaaacgggtcccgtacggtccgtttaaggtacgtttaccgtacggtaccggttaggaccggggtaaccaaaccggttaagcgggtaacgccgtaaccggttcaaccggttcttacccggtgttaccccggtcgggttaccggaccgggttaaacggccggttacgtcggtaaccgttgttacccgtccgg

SEQ ID NO: 283183 - DNA, 742 bp, Homo sapiens
  misc_feature: GYAE6OF02HAVP6.52.39.D06.1.454.CMB.1.raw
  modified_base (169)..(169): a, c, t, g, unknown or other
  misc_feature (169)..(169): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcgctcccagatgggtcctgtcccagctgcagctgcgaggngtccgggcccaggactgggtacgaacgtccgttcgggacgtaccccgtcgtccccctaccaccgtgcctagttcgttcggttcgttgggtcggccttaccgatcgagccgtaggtttacggttttacctttttacgtaacgttaggttacggtacgtccgaccgtaccggacccccggaaggggaacgggacgtagggtacggtagggtaggttggggagttcgttactagtacgtaagttaggtagggacggtaccttacgtaaccgtacccgtcccgttacctacgaacgaccgccgtacgtaccgaacctacgtaactacgacgtacggacctacgtaccgaaccggtaaccctacctacccgtacctacgaccttacctacttcgtacggttaccggaccgaccggaccgtaccggtcttaggttattcgttcggtaggtccggaacgggtacgaaccgtaaggtcggtacggaccgtaccgttccgtccttacggtaccgtaccgtaccggttccggacgggtaccggtacgggtacggtcgtacggtacgtacccgttcgttacccg

SEQ ID NO: 283184 - DNA, 1034 bp, Homo sapiens
  misc_feature: GYAE6OF02JNJF1.52.39.D06.1.454.CMB.1.raw
tcagcgcagtacgacacgaccggtgctcgatttagtgacatctcgcagttctttgggggatgctttctgagagtcatggacctcctgtgcaagaacatgaagcacctgtggttcttcctcctgctggtggcggctcccagagtcgggtcctcgtcccagctgcagctgaccgagggtacggtccggcccgaggtacgtggtacggaacgtccgtttcggaccgtacccgtccgaccccctcacccgtgcctagttcggtcggtcgtcgggtcgggtccctaccgtacgtaccgacggtacgtacgggtttaaccggtttttaacccttttttacgtaaaccccggttagggtttacgggtaccggttaccccggaccccccgtaacccggaacccccccgggtaaggggggaaaaacccggggttaacgtacgggtaacgggttagggttaacggggttacgggggtttaacggttaccgggttttacgtaagttaacccggttaaggtaacggggttaccgggggtaaccggttaacccgtttaccgtaaacccggtaccccgtcccccggtttaaccccgtaacggtaaaccgggtacgtaacccggtaagttaaccccgtaacctaacttaacggttaccaacgggttacgaacccgggtaaccgttacccgggtaaacccggaaacccttacccccgttccgttaacccccgttaacgaacccccttaacgtaaacccgtttccgggttaccggttaaccccggggaccccgtaaaccggggtaacccggtaacccgggttaccggttaacggtttaaccggtttaacggttcgggtaaccgggaccggggttaaaccgggggtaaccgtaaaacccgggtaaggggttacccggtaccgggtacccgttacccgtacccgtttacccgtaccgttaccggttaacccggtcccgggtcggtaaccgggggtacggtaaccggggaaggttcccgggttacggtacccggttacgtccccggttccccgg

SEQ ID NO: 283185 - DNA, 757 bp, Homo sapiens
  misc_feature: GYAE6OF02I6B9K.52.39.D06.1.454.CMB.1.raw
  modified_base (160)..(161): a, c, t, g, unknown or other
  misc_feature (160)..(161): n is a, c, g, or t
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcnnctgcaggacgtcgggcccaggactggtagaacgtccgttcggacgtacccgtcgcccctcaacctgacctagttcgtcgtccgtagggtcggccttccgaatccgagctaggtacgtttacgttttacacgtaggtcggtagtccgacctacggacccccgaagggaacgggtacgtaacggacggtgggagtttagggacgttcgtacgattaccgtaagtaggtacgggggtaccgtaccgtttaccgtaccgtaaccgtccccgtacctacgaaacggtacgaccgtaacggtaccactaacgtaacttacgaaagtaccgaacgtacccgaccgtaaacgacctaaccctccacccgttacgtaacctaccctacttccgttacggtaacccggtcgaccggtaacccgcgggtacccgtattacgtttacgtcggtcggaacggtacgggacctaacccggtaaagtcgggaaccgttacgggaccgttaccgtaccctttacgtaccgtttaaccggtaccgttacgggtaaccggggtaccggttaacgggaccggttcgttccgggtacaccgggtttcctaccccgg

SEQ ID NO: 283186 - DNA, 834 bp, Homo sapiens
  misc_feature: GYAE6OF02FZFGW.52.39.D06.1.454.CMB.1.raw
tcagcgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgcccctcacctgcattgtcgtctgggtggcctccatcagcaggttacggttactttttactacgtaggttggacgttccgaccgacgacccccgtaaggggaacgggtaccgtaaggtaggtacgggtaaggtttacggggtagtttaggttaccgtaagttaccgaaagttaaagggtacgggggtaacggtaaccccttttacgtaaccgtaccggttacccccgtaccccgttaacgaaaccgggaaccggtacccggtaacgttacccgaaacccgtaaacgttaacctaaccgtaaacgttaacggaaccgtaacccggtaacccggaaacccggaaacccccgtaacccgttaccctaccccgtaaccgtaaaccccttacctaaacccgttccgttacggttaacccggcccggaccgggtaacccgtaccgggtccgttaggttaacgtttactacgggttacggacgggtaacgggtaaccggtaaccgtaaaaggtcgggtacggacccgtaacgtccgttacccgttacgtaccgtttacccggacccgtttaccggtacccgggaccggtaacggggaccggttcggttaccggtaccgtacggttcccgtacccg

SEQ ID NO: 283187 - DNA, 829 bp, Homo sapiens
  misc_feature: GYAE6OF02IYHP7.52.39.D06.1.454.CMB.1.raw
  modified_base (144)..(144): a, c, t, g, unknown or other
  misc_feature (144)..(144): n is a, c, g, or t
tcagcgcagtacgacacgaccggtgctcgatttagtgacatctcgcagttctttggggatgctttctgagagtcatggacctcctgtgcaagaacagtgaagcacctgtggttccttcctcctgcgtggtggcgcctcccgagngtggtcctgtcccgagtctgacagtctgacgaggcggtcggcccgaggtacgtggtagacggtccgttacgggaccgtaccctccggcccctcgtaccgtcgcttagttggtccgttcgtagggttccgcctacctagtacgacgtcgttaaggttcggtttaaccttttacgtaacgttcggttaggtaccgtaccgacccgtacccggtaccccgggtaagggtaaccgggtacgtaggtacggtacgggtaggttacggggtacgttcgttacgtaagtacgtaagttacggtacggggttacgtacccttacgtacggaccccgtacccgtttacccgtaagaaccgggtaccgaaccggttacgtaaccgacccttaagtaacctacggtaaccggtacgtaccgtaaccgtaccgtaacccgtaacccgtacccgtacccgttacccgtaccgtaacccgttaccgttaaaccgtaccgttaccggttaccggtaccgtacccggtagtacccccccccccccggtagttacgttacgttacgttacggtacggtacggtacgggtaccggtaaccgtaacggtacggtacggtaccgtacgtacgtaccgtccgtacgtaccgtcggtaccggtccggtacggtacggacggtacgtcggtacgtcgtaccgttaccg

SEQ ID NO: 283188 - DNA, 751 bp, Homo sapiens
  misc_feature: GYAE6OF02GMBKO.52.39.D06.1.454.CMB.1.raw
  modified_base (721)..(721): a, c, t, g, unknown or other
  misc_feature (721)..(721): n is a, c, g, or t
tcagcgcagtacgacacgaccggtgctcgatttagtgacatctcgcagttctttgggatgctttctgagagtcatggacctcctgtgcaagaacatgaagcacctgtgttcttcctctgcgtggtggcggctcccagagtcggtcctgtcccagctgcagcgtgcgaggtacggtccggacccgaggacgtggtagaacgtcccgttacggacgtccccgtcgacccctccaccgtcgctagttcggtcttcgtggtcggcctcgagcagcgtaggttcgtttacttttacgtaacgtggttaggcgtaccgcccgtaccggaccccgaaagggaacggaccgttaggaggttacggtacggttacgggagtttacgttaacgacttaacgtaagttaacgggtacgggaacgttaccttaccgtaaccgacccggtcccgttacccgtacgaacgacgacgtaactccgaactagttacgtacgacgtacgaactaacccgacgaaccgaacccttcccgtcccttacgtaccgaacccgtctaaccgtcgttaaccggtcccgaccggtccgaaccgtcggtaccgttgttaacgttcgttggtaaccgggcgtaacgggaccgtaaacgtaagggttcggccgtacggcctttccggtacccgttcgtaaccgtttacctaacccgggttccggtacggggtaccaacggggttaccnccggttaggtcccgtagttcccgttacccg

SEQ ID NO: 283189 - DNA, 154 bp, Homo sapiens
  misc_feature: GYAE6OF01BIDYB.8.53.E09.1.454.CMB.1.raw
  modified_base (152)..(154): a, c, t, g, unknown or other
  misc_feature (152)..(154): n is a, c, g, or t
tcagctcgcgtgtccacgaccggtgctcgattagagagagtgtgttggttggtgtggtggtctccactccgccttgacggctgctatctgccctcggtcactctgttccgcctcctcgacacgcgagctgagcggctggcaaggcgcatagnnn

SEQ ID NO: 283190 - DNA, 163 bp, Homo sapiens
  misc_feature: GYAE6OF01A7WFQ.8.53.E09.1.454.CMB.1.raw
  modified_base (163)..(163): a, c, t, g, unknown or other
  misc_feature (163)..(163): n is a, c, g, or t
tcagctcgcgtgtccacgaccggtgctcgatttagagagagtgtgttgggtttggggtgtggtggtctccactcccgccttgacgggctgctatctgcccctcggtcactctgttcccaccctcctcgacacgcgagctgagcgggctggcaaggcgcatagn

SEQ ID NO: 283191 - DNA, 177 bp, Homo sapiens
  misc_feature: GYAE6OF01CAQLL.8.53.E09.1.454.CMB.1.raw
  modified_base (167)..(177): a, c, t, g, unknown or other
  misc_feature (167)..(177): n is a, c, g, or t
tcagctcgcgtgtccacgaccggtgctcgatttagagagagtgtgttgggtttggggtgtggtggtctccactcccgccttgacggggctgctatcctgccccctcggtcactctgttcccgccctcctcgacacgcgagctgagcgggctgggcaaggcgcatagnnnnnnnnnnn

SEQ ID NO: 283192 - DNA, 165 bp, Homo sapiens
  misc_feature: GYAE6OF01BZV1Z.8.53.E09.1.454.CMB.1.raw
  modified_base (165)..(165): a, c, t, g, unknown or other
  misc_feature (165)..(165): n is a, c, g, or t
tcagctcgcgtgtccacgaccggtgctcgatttagagagagtgtgttgggtttgggggtgtggtggtctccactcccgccttgacggggctgctatctgccccctcggtcactctgttcccaccctcctcgacacgcggctgagcgggctggcaaggcgcatagn

SEQ ID NO: 283193 - DNA, 166 bp, Homo sapiens
  misc_feature: GYAE6OF01B6CDL.8.53.E09.1.454.CMB.1.raw
  modified_base (165)..(166): a, c, t, g, unknown or other
  misc_feature (165)..(166): n is a, c, g, or t
tcagctcgcgtgtccacgaccggtgctcgatttagagagagtgtgttgggtttggggtgtggtggtctccactcccgccttgacggggctgctatctgccccctcggtcactctgttcccaccctcctcgacacgcgagctgagcgggctggcaaggcgcatagnn

SEQ ID NO: 283194 - DNA, 165 bp, Homo sapiens
  misc_feature: GYAE6OF01E0W84.8.53.E09.1.454.CMB.1.raw
  modified_base (165)..(165): a, c, t, g, unknown or other
  misc_feature (165)..(165): n is a, c, g, or t
tcagctcgcgtgtccacgaccggtgctcgatttagagagagtgtgttgggtttggggtgtggtggtctccactcccgccttgacggggctgctatctgccccctcggtcactctgttcccaccctcctcgacacgcgagctgagcgggctggcaaggcgcatagn

SEQ ID NO: 283195 - DNA, 437 bp, Homo sapiens
  misc_feature: GYAE6OF01B2QYW.8.53.E09.1.454.CMB.1.raw
  modified_base (430)..(437): a, c, t, g, unknown or other
  misc_feature (430)..(437): n is a, c, g, or t
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctggtcactctcgttcccaccctcctcgacacgcgagctgagcgggctggcaaggcgcatagnnnnnnnn

SEQ ID NO: 283196 - DNA, 166 bp, Homo sapiens
  misc_feature: GYAE6OF01C7LWO.8.53.E09.1.454.CMB.1.raw
  modified_base (166)..(166): a, c, t, g, unknown or other
  misc_feature (166)..(166): n is a, c, g, or t
tcagctcgcgtgtccacgaccggtgctcgatttagagagagtgtgttgggtttgggggtgtggtggtctccactcccgccttgacggggctgctatctgccccctcggtcactctgttcccaccctcctcgacacgcgagctgagcgggctggcaaggcgcatagn

SEQ ID NO: 283197 - DNA, 504 bp, Homo sapiens
  misc_feature: GYAE6OF01DRNZI.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcgccctcagggtctctgaccgattctctgcctcaagtctggcacttctgcctcctgtcatatctgtctccgagggtgaggatgaggctgtattattactgccactcctatcgacaacgcgcctgtagttatttggcttggttccgggacggtccgggtacctaaggttcccgg

SEQ ID NO: 283198 - DNA, 531 bp, Homo sapiens
  misc_feature: GYAE6OF01D36F0.8.53.E09.1.454.CMB.1.raw
  modified_base (357)..(357): a, c, t, g, unknown or other
  misc_feature (357)..(357): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataacaacaatcggccctcgaggggtctctgaccgattcnctgcctcaagtctggctacttctcgcctccgtgtcatatctgtctcgagggtcaggntgngctgtattagttactcgcctactcctatcgaacaacgcgcctagtagttagtttggtcgttggttccgggcgggtaccgggaacctaagggtttcgacccgttcccgtaaccgg

SEQ ID NO: 283199 - DNA, 494 bp, Homo sapiens
  misc_feature: GYAE6OF01EDXFA.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaaatcggccctcaggggtctctgaccgattctctgcctccaagtctggcacttctgcctccctggtcatatctggtctccgagggtgaggatggaggctgtattattactgccactcctatgacaacgagcctgagtattggcttggtcggcggcggacagttacgg

SEQ ID NO: 283200 - DNA, 171 bp, Homo sapiens
  misc_feature: GYAE6OF01EPMQU.8.53.E09.1.454.CMB.1.raw
  modified_base (165)..(171): a, c, t, g, unknown or other
  misc_feature (165)..(171): n is a, c, g, or t
tcagctcgcgtgtccacgaccggtgctcgatttagagagagtgtgttgggtttgggggtgtggtggtctccactcccgccttgacgggctgctatctgccccctcggtcactctgttcccaccctcctcgacacgcgagctgagcgggctggcaaggcgcatagnnnnnnn

SEQ ID NO: 283201 - DNA, 615 bp, Homo sapiens
  misc_feature: GYAE6OF01C7OK9.8.53.E09.1.454.CMB.1.raw
  modified_base (282)..(282): a, c, t, g, unknown or other
  misc_feature (282)..(282): n is a, c, g, or t
tcagctcgcgtgtccacgaccggtgctcgatttagagagagtgtgttgggtttgggggggctctgcttcagcctggtgggcacaagaggcagcactcaggacaatctccagcatggcctggtctcctctcctcctcactctcctcgctcactgcacagggtcctgggcccagtctgtactgacgcagcccgccctcagtatccgtcggggcccccagggcaggagggtcctccatcctcctgcacgtggggacgcacgaaccagcagtcggggctaggttangatgtcattcggtaccaccgtacggtccgaggccacgacgcccccagtacctcctactaatttaactagaactaaacaaacgtaacgttcccggccctacggtaacggggttcctacgtacgaccgtattcctcgtcgccctacgaacgttctcggccttacttcctcgtccccttcccgtggtcctattacgttccgttcgggtcctccgggtagggttcggaggtagttggagtcgttagtatttactactcgtcctaccgttcctagtcgaacacgacgtccgtagtagttacgttgtcgttcggtcggcggtaccgacgttagtcccgg

SEQ ID NO: 283202 - DNA, 551 bp, Homo sapiens
  misc_feature: GYAE6OF01DB2CV.8.53.E09.1.454.CMB.1.raw
  modified_base (393)..(393): a, c, t, g, unknown or other
  misc_feature (393)..(393): n is a, c, g, or t
  modified_base (434)..(434): a, c, t, g, unknown or other
  misc_feature (434)..(434): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtggggccccagggcaggagggtctccatcctcctgcacgtgggagcagaaccagcaatcggggcaggttatgatgttcattggtaccgccaggttccaggcacacggcccccagacctcctcaattaatgaactaacaaacaactcggaccctcgaacgggtcctctgaccgtattctctcgcctccaagtcnggcctacttctcgtccctcctggtcatactcgtgtctccgngggtcgagtagtgaggtctagtattatactgcctacttcctatcgacaacgacgtcctagtgttagtttggacgttcgggttacgggcgggtaccgggtaccgtaaggttacccggg

SEQ ID NO: 283203 - DNA, 525 bp, Homo sapiens
  misc_feature: GYAE6OF01DKO69.8.53.E09.1.454.CMB.1.raw
  modified_base (332)..(332): a, c, t, g, unknown or other
  misc_feature (332)..(332): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (473)..(473): a, c, t, g, unknown or other
  misc_feature (473)..(473): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtggggcccccagggccaggagggtctccatctcctgcactggggagcagaaccagcagtcggggcagggttatgatgttcagttcggtaccgccaggttccaggccacacgcccccagacctcctcaattaangaataacaaacaactcggccctcgagggtctctgaccgtattctctcgcctcgaagtctggctcttctcgcctcctggtcatntcgtgtctcgagggngaggatgaggctgtattatactcgcctactcctatcgacaacncgtctgtagttagttggtcttcggttcggcggccgggacgtacggttaccgg

SEQ ID NO: 283204 - DNA, 760 bp, Homo sapiens
  misc_feature: GYAE6OF01ECJTA.8.53.E09.1.454.CMB.1.raw
  modified_base (243)..(243): a, c, t, g, unknown or other
  misc_feature (243)..(243): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcggggccccagggcaggaggtctccatctcctgcacgtgggancagaaccagcagtcggggcaggttatgattgtctagttcgggaccgcgtacggttccaggccaaccgacgacccccaaagaccttcctactaattaaactagaacttaaaaccaaacgtaaacgtcccgggacccttacggaacggggttcctacgtacgtaacccgtactttccgtcgttaccgcccttaaccgtaacggttccgttacggaccttaaccgtttcccgttacggtcccctttcccgttacgggttacctagtttaaccgttccgttcgggtttaccgttcccggtaaggggttacgggtacgggtaacgttgggaaccgggttccgttaggtttaacgtttaacgtttaccgtaccggtaccccttaaccgttacccgttaacgttaccggtaaacccgtaaacgtaccggttacccgttaaggttaacgtttaacggttttgggtaccgtttcgggttaccggggaccggggtacccgggtaaaccgtaacgggtttaccccggg

SEQ ID NO: 283205 - DNA, 166 bp, Homo sapiens; identical to SEQ ID NO: 283196
  misc_feature: GYAE6OF01EB1R0.8.53.E09.1.454.CMB.1.raw
  modified_base (166)..(166): a, c, t, g, unknown or other
  misc_feature (166)..(166): n is a, c, g, or t

SEQ ID NO: 283206 - DNA, 626 bp, Homo sapiens
  misc_feature: GYAE6OF01DQ96W.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcaggagggtcctccatcctcctgcacgtggggagcagaaccagcagtccgggggctaaggttatgaattgttctagttcgggtaccgccgtagggttccaggcaccacgcccccagacctcctacaattaatgaataacaaacaacgtccggccctacgagggtcctcgtcgaccgtattctctcgccctacaagtctcggctacttcgtcgtccctcccgtggtcctacttatccgttggtcctccgtaggggtcgagggtatggaggtccttaggtatttagttaccgtcgtaccctacttacccgtataccgtaacctaacgtacgtcccgttaggtaacggtttacgtttgggaccgtttcgggtttaccggggcgggttacccggggtaaccgttaagggttaccccggg

SEQ ID NO: 283207 - DNA, 481 bp, Homo sapiens
  misc_feature: GYAE6OF01EWQ83.8.53.E09.1.454.CMB.1.raw
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
  modified_base (472)..(481): a, c, t, g, unknown or other
  misc_feature (472)..(481): n is a, c, g, or t
tcagctcgcgtgtccacgaccggtgctcgatttagagagagtgtgttgggtttgggggggtgtggtggtctccatctcctgcactggggagcagaaccagcatcggggcaggttatgatgttcattggtaccgccaggttccaggcacacgccccccagacctcctcattaatgataacaacaatcggccctcgaggggtctctgaccgtattctctcgcctccaagtctggcctacttctcgccctccctggtcatatctggtctccgagggtgaggatggaggctgtattattactcgcctactcctatcgaacaacagcctagagttatttggcttggtcgggcggacggaccaagttcgaccgtctacgtcacgacccaaggcctcgcccccgtcggtaccactcctccgttccccgccctccgtccgacnccgcgagctggcggccgggctggacgaggccncatgnnnnnnnnnn

SEQ ID NO: 283208 - DNA, 495 bp, Homo sapiens
  misc_feature: GYAE6OF01A6K4C.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgactaacaacaatcggccctcaggggtctctgaccgattctctgcctccaagtctggcacttctgcctccctggtcatatctgtctccagggtgaggatgaggctgattattactgccactcctatgaacaacagcctgacgttatttggcttgttcggcggcggaccaggttacg

SEQ ID NO: 283209 - DNA, 546 bp, Homo sapiens
  misc_feature: GYAE6OF01B2CRT.8.53.E09.1.454.CMB.1.raw
  modified_base (234)..(234): a, c, t, g, unknown or other
  misc_feature (234)..(234): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaccagcatcggggcaggtatgatgttcattggtaccgccaggttccaggcacacgccccagactcctacattaatgaactaaacaacaactcggccctcgaggggtcctctcgaccgtattctctgcctccaagttctcggctacctttctcgcccttcccgtggtacactatcgtggtacctccggtagggtgagggtatggaggtctgtatttactactcgacctacttcctatcgaacaactgcctagtacgttattggcttggttccggcgggtcgggaccctaaggttcgtaccgtccgtaacg

SEQ ID NO: 283210 - DNA, 450 bp, Homo sapiens
  misc_feature: GYAE6OF01BV85F.8.53.E09.1.454.CMB.1.raw
  modified_base (301)..(301): a, c, t, g, unknown or other
  misc_feature (301)..(301): n is a, c, g, or t
  modified_base (425)..(425): a, c, t, g, unknown or other
  misc_feature (425)..(425): n is a, c, g, or t
  modified_base (433)..(450): a, c, t, g, unknown or other
  misc_feature (433)..(450): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacngcctgagtattggctgttcggcggcgggacaagttgaccgtctacgtcagcccaaggcctcgccccctggtcactctcgttcccaccctcctcgacacgcagctgacgcgggctggcgaaggcncagtagcnnnnnnnnnnnnnnnnnn

SEQ ID NO: 283211 - DNA, 680 bp, Homo sapiens
  misc_feature: GYAE6OF01A7B1F.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcggggccccagggcaggacgggtctccatcctcctgcacgtgggagcagaaccagcagtcggggactaggttatgattgttactagttcgggtaccgccgtagggttccaggccacgacgacccccagaccttcctactaatttaactagaactaaacaactaactccggaccctcgacggggttcctacgtacggacccgtattccgtcgtccgtccctaccgtaagtccgtcggtcctaccgttctcgtccccttccgtcggtctacttactcgttcggtcctcgggtacgggtgtagggtagtggtacggtcgttaggttaactttagttacccgtcgtaccctaccgttaccgtattaccggaacctaacggtaccgtaccgttacggttaacggtttaacgtttcgggtacggtttcccgggttacggggtaccggggtttaccgggtaacccggttaacggtttaaccccggg

SEQ ID NO: 283212 - DNA, 633 bp, Homo sapiens
  misc_feature: GYAE6OF01BR1LJ.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtctccatctcctgcacgtgggagcaagaaccagccagtcggggcaggttatgtatgttcagttggtaccgcgtacggttccaggcacgacgcccccagacctcctctaattaatgaataacaacaatccggcctacgacgggtctcgtacgtaccgtacttctccgtcgccctaccgaagttccgtcggtacctactttccgtcgtaccctcccgttgtacctattacttccgtcggttcctaccggtaggggtgagggtatcgggaggtcttaggtatttacgttactcgtaccctaacttccctaagtcgaaacctaccgtacggtcccgttaggtaacggtttacgtttcgggccgtttacggggttcgggacccggggttaccgggaacccgttaggtttaccccggg

SEQ ID NO: 283213 - DNA, 450 bp, Homo sapiens
  misc_feature: GYAE6OF01B8J1U.8.53.E09.1.454.CMB.1.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
  modified_base (435)..(450): a, c, t, g, unknown or other
  misc_feature (435)..(450): n is a, c, g, or t
tcagctcgcgtgtccacgaccggtgctcgatttagagagagtgtgttggggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgcctactcctatgacaacagcctgagtatttggcttggttcggcggcggacaagttgaccgtcctacgtcacgcccaaggcctcgcccctggtcactctcgtcccgccctcctcgacncgcgngctgagcgggctggcaaggcncgatagnnnnnnnnnnnnnnnn

SEQ ID NO: 283214 - DNA, 535 bp, Homo sapiens
  misc_feature: GYAE6OF01E3M7L.8.53.E09.1.454.CMB.1.raw
  modified_base (240)..(240): a, c, t, g, unknown or other
  misc_feature (240)..(240): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggacncagaaccagcatcggggcaggttatgatgttcattggtaccgccaggttccaggcacacgcccccaagactcctcattaatgataaacaacaatcggccctcaggggtctctgaccgattctctcgcctccaagtctggcacttctgccctcctggtcatatctggtcctccgagggtgaggatggagctgtatttattactgacccacttcctatcgaaccaacgacgtccttagagttatttagggccgtttcgggttccgggccggtccgggtaccgtaaggtttacccggg

SEQ ID NO: 283215 - DNA, 865 bp, Homo sapiens
  misc_feature: GYAE6OF01CF873.8.53.E09.1.454.CMB.1.raw
  modified_base (192)..(192): a, c, t, g, unknown or other
  misc_feature (192)..(192): n is a, c, g, or t
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacgaggtcctgggcccagtctgtactgacgcacgccgccctnagtactcgtcggggccccagggcaggagggtctccatctcctgcacgtgggancgacgaaccagcaacgtcggggactaggttangtattgttacgagtttcggaccgccgtacggttcccaggaccaccgaccgacccccaagtaccctcctactaatttaaaacgtacgtaaacttaaaaccgaaaccgtaacgttccccggacccgttacggaaccggggtttcctaccggtaacgggtaaccccttacgtttcccgtccgtttaccggtaccccgttaccgtaaaccggtttccgtacgggttaccccttacccgtttcccgttacccggtaccccctttacccggtacggtttacctaaccgtttaccgtttaccggtttcccgggttaccccgtttaccccggggtaaaggggttttacggaaaccggggttaacgtttacggggaaccgggggttactttaacggggtttaaaccttttttaacttaccgggtttccccgtaaccctaccgtttaacccgttaacgttaacccgaaaccgtaaaccgtaccggttccgtttaacgggttaggttttaccgggttttacgggtaccggtttacggggttaccccggggtaaccgggggtacccgggttaaaacccgttagggttttaaccccccggg

SEQ ID NO: 283216 - DNA, 449 bp, Homo sapiens
  misc_feature: GYAE6OF01CMVWV.8.53.E09.1.454.CMB.1.raw
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
  modified_base (429)..(449): a, c, t, g, unknown or other
  misc_feature (429)..(449): n is a, c, g, or t
tcagctcgcgtgtccacgaccggtgctcgatttagagagagtgtgttgggtttggggggtggtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgccctccaagtctggcacttctgcctccctggtcatatctggtctccagggtgaggatgaggctgattatactgccactcctatgaccaacagcctgagtattgctgtcggcggcgggacagttcgaccgtctacgtcagcccaaggctcgcccctgtcnctctcgttcccgccctcctcgacacgcgagctgacgcgggctggcaaggcgnagtagnnnnnnnnnnnnnnnnnnnnn

SEQ ID NO: 283217 - DNA, 825 bp, Homo sapiens
  misc_feature: GYAE6OF01DQWBK.8.53.E09.1.454.CMB.1.raw
  modified_base (207)..(207): a, c, t, g, unknown or other
  misc_feature (207)..(207): n is a, c, g, or t
  modified_base (272)..(272): a, c, t, g, unknown or other
  misc_feature (272)..(272): n is a, c, g, or t
tcagctcgcgtgtccacgaccggtgctcgatttagagagagtgtgttgggtttggggggctctgcttcagctggtggcaacaagaggcagcactcgaggaacaatcctccagcagtcggcctggtctcctctcctcctcactcctcctcgctcactcgcacgacgggtccgtcgggacccagtctgtactgacgcacgcccgccctnagtactcggtccgggacccgagggcaggacgggtcctcacttcctccgtgaccacggtggggacncgaaacgaaccacggactaacgggtccggggacgttaaggttagtagtagtttcgttactaggtttaccgggtaccggaccgtacgggttaccgaggacccaaccgacccgacccccgaagtcccttacccttactaaaatttaacgtagtaaactaaaaccaaacgtaaaccgttcccgggaccccgtagggtacggggttcctaccgtacggaaccttacgttcctcgtccctaccctaacgtacgttccgcggaccttagtttcccgtaccgtccccgtttaccggtcggttacctacttacttcggttaccggttaccctaccgggttaaggggtgaaacgggtgttacgggtaacggttcttaaggtttaacttttaacgtttaccgtaccggtcccttaaaccgttcctaaaggtaccgtaaacccaaacgttaccgggttaacccgttagggtttaaccggtttttaacgggtttggttccgtttacgggggggttaccgggacccgggggtacccgggtaaagttaacccggggttaacccccgg

SEQ ID NO: 283218 - DNA, 644 bp, Homo sapiens
  misc_feature: GYAE6OF01ASIFC.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgagggtcctgggcccagtctgtactgacgcacgcccgccctcagtactcgtcggggccccaggggcaggagggtcctccatcctcctgcacgtgggagcagaaccagcagtcggggcaggttatgattgttcagtttcggtacccgccgtacggttccaggccacgaccgcccccagtacctcctactaattaactagaactaaacaaactaacgtccggccctcgacgggtctcgtcgaccgtacttcctcgtacgtccctaccgtaacgttccgtcggtcctaccgtttccgtcgtcccttacccgttggtacctacgttacgttccgtcggttccctccggtaggggtcgaagggttacgtggacggtcttaggtatttacgttactcgtccctacgttcctagtcgaaccaacgtcgtaccgtaggttacgttagttcggtacgttcggttccgggaccgggtaccgggtaacgttacggttcccgg

SEQ ID NO: 283219 - DNA, 968 bp, Homo sapiens
  misc_feature: GYAE6OF01CXUJS.8.53.E09.1.454.CMB.1.raw
  modified_base (149)..(149): a, c, t, g, unknown or other
  misc_feature (149)..(149): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactcctcctcgcctacncgtcacacggtcggtccggcccggaccgtacgtcgtacgtacgacgaccgacgacccggccccgtccctacgtaacgttaccgttccggggacccccgggacccgggacgggacggaacggggtaccgttcctaaccgttaccttcccgtccggtaccgaccggttacggggacggaccgaacggaaacccgaaaccgacggaacggtaaccgggggtccgggtaacggtttaaggttacgtaagttacggtttacgttacggttacggttaccccggaacccgtaccggttaccggtaccggaccgaaccgacccgacccgaccccgtaacgttaccctacctaacttaacgttaacgtaacgtaaacctaaactaaaccgtaccggtaccccggtacccgtaacggggttaccggttaccgtaccggttaaccccgtacgtttaccgttcccgttaccgttaccccgtacccgttaacgtaaccggtttccgggtcccgttaacccttttcccgttccgtaccccccgtttccccgtttaacggttaccgttaacgttacgtttaccggttccgggttacccgtacccgggttaacgggttacggggttaacggaacgggttcgggtaacggtaccggttttaacggttaacgttttaaccgtttaacgtttacgcccctttaaccgttacccgttaaacgtacgtaaaccggaacctacggtaccgttacgttaagggttttaacgttcgggttaccggtcggttacgggggaccgggtaccggggtaaacccgttaagtttaccgggtacccccg

SEQ ID NO: 283220 - DNA, 545 bp, Homo sapiens
  misc_feature: GYAE6OF01CDEUS.8.53.E09.1.454.CMB.1.raw
  modified_base (443)..(443): a, c, t, g, unknown or other
  misc_feature (443)..(443): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctcggggccccagggcaggagggtctccatctcctgcacgtgggagcagaaccagcagtcggggcaggttatgatgttcattggtaccgccgtaggttccaggcacacgcccccagacctcctactattaatgaactaaacaacaacgtccggcctcgaggggtctcgtcgaccgtattctctcgcctactaagtcgtcggcctacttctcgccttccgtgtcatctctggtcctcgagggtgagngtgagtctagtattattactcgcctactctatcgactaacgcgtctagtagttcgtttcggcgttgggttccgggacgggacgggtaccgtaaggttcccgg

SEQ ID NO: 283221 - DNA, 591 bp, Homo sapiens
  misc_feature: GYAE6OF01D62HJ.8.53.E09.1.454.CMB.1.raw
  modified_base (235)..(235): a, c, t, g, unknown or other
  misc_feature (235)..(235): n is a, c, g, or t
  modified_base (402)..(402): a, c, t, g, unknown or other
  misc_feature (402)..(402): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatcgtggggccccagggcagaggtctccatctcctgcacgtgggancagaaccagcatcggggcaggttatgatgttcattggtaccgccaggttccaggccacacgccccccagacctcctcattaatgaataacaacaatcggccctcaggggtctctgaccgtattctctcgcctccaagtctggctacttctcgccctccctggtcatntctggtctccgagggtgaggtagtgaggcttgaatttacttacgtcgtccctacttcctatacgaaccaacgtcgacccttaggtaacggtttagtttcgggtcgtttcgggttcccggggaccggggtacccggggtaaacccgttaagggtttacccggtaaccccggttcccgttaaaccccgggg

SEQ ID NO: 283222 - DNA, 534 bp, Homo sapiens
  misc_feature: GYAE6OF01E1F5N.8.53.E09.1.454.CMB.1.raw
  modified_base (297)..(297): a, c, t, g, unknown or other
  misc_feature (297)..(297): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcagtcggggcaggttatgatgttcattggtaccgcaggttccaggcacncgccccagacctcctacattaatgataaacaacaatcggccctcgacgggtctcgtcgaccgattctctgcctcaagtctggctacttctgccctcctggtcatactcgtgtctccgaggtgaggatgaggtctgtatttattactcgacctactcctatacgaacctaacgacgtctaggtacgttagtttggcgttcgggttccgggcgggtccgggtaaccgtaggttacccgg

SEQ ID NO: 283223 - DNA, 587 bp, Homo sapiens
  misc_feature: GYAE6OF01DM4V3.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgccgccctcagtatcgtcggggcccccagggcaggagggtctccatcctcctgcacgtgggagcagaaccagcagtcggggcgaggttatgatgttctattggtaccgccgaggttccaggcaccacgcccccagtacctcctacattaatgaataacaactaactccggaccctcggtaacgggtctacgtcgtaccgtacttctcctcgtccctaccaagtcgtcggtcctacttctcgtcccttccgtgtctatatcgtcgtctccgaggtgagatgaggtctagtatttacttactcgtacctaccttacctagtacgaaccaacgtacgtaccgtagtaggttacgttggtaccgttcggttaccgggcgggtaccgggtaaccgtacggttacccgg

SEQ ID NO: 283224 - DNA, 725 bp, Homo sapiens
  misc_feature: GYAE6OF01A0PCN.8.53.E09.1.454.CMB.1.raw
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcaggagggtctccatctcctgcacgtgggagcagaaccagcagtcggggcaggttatgattgttacagtttcggtacccgccgtaggtttccaggccaccgacgcccccagacctccgtacattaatgaactaacaactaacgtccggccctacgacggggtcctcgtacgtaccgtattcctctcgtccctcgtaacgtctcggtactacctttccgtaccgtccccttcccgttaggttacctacttacgttccgttcgggttcccgttacccgggtaggggtaccggtaagggtacggttacgggtacgggtctttaaggttaacttttacgtttaacccgttcggtaccccttaaccgtttacccttaacgtaccgaaccgtaaccgtaccgttcccgttaggttaaccggttttagtttcgggttccgttacggggtttacccggggacccgggggttaccgggtaacccgttaacggggtttacccggtaaccccggtttcccgttaacccggg

SEQ ID NO: 283225 - DNA, 568 bp, Homo sapiens
  misc_feature: GYAE6OF01DTD4D.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcggggccccagggcagaggtctccatcctcctgcacgtgggagcagaaccagcagtcggggactagggttatgattgttctagttcggtaccgcgtacggttccaggaccacacgcccccagacctcctctaattaatcgaataacaacaacgtccggaccctacgacgggtctcgtacgaccgtattctctcgacctacaacgtctacggctacttcgtcgtccctcctggtcctattactcgtcgtcctaccggagggtgaggtgtgacggtctagtactttactacgtcgacctactacctatcgaacacgacgtctagtagttacttggcgttcggtacgggcgggtacggcgtagttaccgg

SEQ ID NO: 283226 - DNA, 704 bp, Homo sapiens
  misc_feature: GYAE6OF01BN3LH.8.53.E09.1.454.CMB.1.raw
  modified_base (244)..(244): a, c, t, g, unknown or other
  misc_feature (244)..(244): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactcgtcgggccccagggcagacggtctccatctcctgcacgtgggancacgaaccagcagtcgggctaggttatgtattgttactagttcggtaccgtccgtacggttccgaggccacgaccgaccccgagtacctcctactaactttaacgacgtaactaaacaaactaacgtacccggtcccgtacggtacgggttcctccgtacgtaacccgtacttccgtactccggtacccttaccgtaacgttccgtacggtaccttaccctttccgtccgttaccccgttccgttacggtaccttaagttaccgttcgttcggttaccgttaccgggaggggttcgaagggtacgtcggtaacgggttcgttagttaactttacctttacgtcgtaccctacgttcctaacgtccgtaaccaacgtcgtacccgttaggttaacgttcggttacggtccgtttacgggttcccggggtaccgggtaccggtaaccgttaggtaccccggg

SEQ ID NO: 283227 - DNA, 775 bp, Homo sapiens
  misc_feature: GYAE6OF01ESQEY.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgccgccctcagtactcgtcggggccccagggcaggacgggtctccatcctcctgcacgtgggacgcaagaaccagcaggtcggggactaggttactgattcgttcgtagttcgggtaccgccgtacggttccgaggccaaccgaccggccccctagacccttcctacgtaattaacgtacgaaactaaaccaaacgtaaacgtcccggtaccccgttacggtaacggggttcctacgttacggtaacccgttactttcctccgtccgtaccccttaaccgtaacgttccgttacgggtacccttaccgttttcccgtacccgttcccccgtttaccggttcgggtaaccttacgtttacgttcccggttccgggttacccgtaccgggtaggggttacgacgggtagtacgggacggttacttagttaactttacggtttacctccgtacccttaccttaccgttaacgaacctaaaccgtaaccgtacggttcccttaagggttacgttttaacggtttcgggtcccgtttacgggggttacccggggaccggggttaacccgggttaacgttaccggggttaacccggg

SEQ ID NO: 283228 - DNA, 702 bp, Homo sapiens
  misc_feature: GYAE6OF01EK003.8.53.E09.1.454.CMB.1.raw
  modified_base (250)..(250): a, c, t, g, unknown or other
  misc_feature (250)..(250): n is a, c, g, or t
tcagctcgcgtgtccacgaccggtgctcgatttagagagagtgtgttgggtttgggggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactcgtcggggccccagggccaggagggtctccatcctcctgcacgtgggancagaaccagcagtcggggcaggttatgattgttctagtttcgggtaccgccgtacgggttaccgacggccacaccggcccccagtaccctcctactaattaatacgtaataaaccaaactaacgtcccggacccctacggacggggttcctacgtacgtaccgtactttcctccgttcggtcccttaccgtaacgttccgtacggtaccctacgtttcccgtccgtaccccgttcccgttcggtacctacttaccgttccgttaccgggttccgtacccgggtaaggggtacgagggtaagtcgggtaacgggtctttaggttaacttttacttaccgtccgtaccctaccgttaccgtagtaccgtaaccaaccgtacgtcgttagttacggttagtttgggaccgtttcgggtccggggaccggggtacggtaccggtaggttaccccgg

SEQ ID NO: 283229 - DNA, 747 bp, Homo sapiens
  misc_feature: GYAE6OF01A0W2X.8.53.E09.1.454.CMB.1.raw
  modified_base (282)..(282): a, c, t, g, unknown or other
  misc_feature (282)..(282): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacgacggtccgtcggccctagtctgtacgtgacgcacgcccgccctacagttactcggtccggggaccccgagggacagggtacggtcctcctacttcctccgtgacgtacggtagggacacgaacgaaccngactaggtcgggacgtagttagtgtagttcgttactagttcggtaccgtaccgtaccggttccgacggaccaaccgaaccggaccccctagtaccttccgtacttaaattaactacggtaaactaaaccaaactaaccggtccccggtacccgtacggttaaccggggttcctacgtaccggtaaccgttacttcccgtacgtccgtacccctacgtaacgttcgtacgtccttaccttccgtaccgtcccttaccggtcggtactacgttacgtcgttccggtccgtacgggtagggtacgtaggtacgtaggacgtacgttagttacgtttattaccgtcgtacctaccgttacctaagtaccgtaacaacggtccgttagtacggttaacgtttacggtacggttccggttacggggttacccgggtacgggtaacccggtaaccgtacgggttaaccccgg

SEQ ID NO: 283230 - DNA, 780 bp, Homo sapiens
  misc_feature: GYAE6OF01DNAUM.8.53.E09.1.454.CMB.1.raw
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatccgtcggggccccagggcaggacgggtctccatcctcctgcacgtgggagcaacgaaccagcagtcggggctaggttatgattgttacagttcggtaccgctacggttccaggccacgaccgacccccagtacctccgtactaattaacgtacgaaacttaaacaaacctaacgtcccggtaccccgtacgtaacgggggttccttaccgtacggtaacccgtactttccgttcctccgtcccttacccgtaaacgttccgttcggtaccttaccgttccgtaccgtcccccgttcccgttacggtacctattacgttacccgttcggttccggtacccggtaggggtacggtaacgggtacgttagggaccgggttacttaaggtttaacttttaaccgtttacgttaccggtacccttaacccgttaccttagttaaccgaaaccctaaaccggttaccgtacccggttaaggttaacgtttaacggttttcgggtccgtttcggggtttcccggggaccgggggttaccccgggtaaaccgttacgggttttacccggtaacccccgggtttcccgttaacccggg

SEQ ID NO: 283231 - DNA, 611 bp, Homo sapiens
  misc_feature: GYAE6OF01B4D8J.8.53.E09.1.454.CMB.1.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (350)..(350): a, c, t, g, unknown or other
  misc_feature (350)..(350): n is a, c, g, or t
  modified_base (482)..(482): a, c, t, g, unknown or other
  misc_feature (482)..(482): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacgagggtcctgggcccagtctgtactgacgcacgcccgcctcagtatcgtcggggccccagggcaggacggtctccatctccgtgcacgtgggacncgaacgaaccngcgagtcggggactaggttatgagttgttacagttcggtaccgccgtacggttccacggccacgaccgccccagacctcctactaagttaanacgtaactaaacaacgtaacgttccggaccctacggacgggttctcgtacgtaccgtacttctcctcgtcctacgaagtcgtcggcttacgtctcgtacccgtcgttgtactatctcgtcgtccgtaccggngggtcgtaggcgtggaacgtcgtagtaacgtttactaccgtcgtaccctacgtccttagacgtaacacgcgtactagtagttacgttcggtcgttcggcgggtacccggacggtaccgtaggttacccg

SEQ ID NO: 283232 - DNA, 725 bp, Homo sapiens
  misc_feature: GYAE6OF01A5DXR.8.53.E09.1.454.CMB.1.raw
  modified_base (445)..(445): a, c, t, g, unknown or other
  misc_feature (445)..(445): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacgagggtcctggggccctagtctgtactgacgcacgcccgtcctcagtatcgtcgggggccccagggcaggacgggtcctccactctcctgcacgtcgggacgcaacgaaccagcgaacggtcggggactaaggttagtaggtattacgttacgtaggtttcggtacccggccggtacggttaccgaggaccaccgaccggacccccagtaacctccttacaatttaagtcgtaaactaaacaaactaacgtcccggtaccctacgggtacgggttcctcgtacgtaccgtnttccgtctccgtccttaacctacggttcgacggttaccttacgttcccgtaccgttccccgttccgttacggttactacgtttaaccgttcgttccggttaccgtaccgggtaagggggttagacgggttaaggtcgggtaacggttataaccgggttaatttaaccgttacgtaccgaccctacttaccgtaataccgaactaacgtcggtaacttggtacgtttacggttggaccgttcggggtaccgggacgggtacggaacgttcgggttacccgg

SEQ ID NO: 283233 - DNA, 597 bp, Homo sapiens
  misc_feature: GYAE6OF01EEY5H.8.53.E09.1.454.CMB.1.raw
  modified_base (237)..(237): a, c, t, g, unknown or other
  misc_feature (237)..(237): n is a, c, g, or t
  modified_base (454)..(454): a, c, t, g, unknown or other
  misc_feature (454)..(454): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatcgtggggccccagggcagagggtctccatctcctgcacgtgggacncaagaaccagcagtcggggcaggttatgatgttcagttcggtaccgccaggttccaggcacacgcccccagacctcctcattaatgaataacaacacgtccggaccctgagggtctcgtgaccgtattctctcgtcctacaagtcgtcgctactttctcgtcccttccgtggtctattatccgttcggtcctccggagggtcgaggtatggacggtntggtaacttacgttacgtacgtcctacttcctagtacaaccaactacgtacgtggtaacgtttgtttcgggcctttacgggtccggggtacccggggtaccggtaacccgttaaggttccggtacccgttcccgttaacccgg

SEQ ID NO: 283234 - DNA, 671 bp, Homo sapiens
  misc_feature: GYAE6OF01E3TTV.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggccccagtctgtactgacgcacgcccgccctcagtatccgtcgggggcccccaggggcaggacgggtcctccatcctcctgcacgtgggagcagaaccagcagtcggggcaggttatgatgttactagttcggtaccgcaggttccaggcacacgcccccagacctcctactataatgaataaacaacaactcggccctacgacggggtctctcgacccgtatttcctctcgtccctaccgaacgtccgtggcctaccgtttcctcgtccccttcccgttcggtacctacttacgttccgttacggttcccgtaccggtaggggtagggtaacggagttcgggaaggttctagttaattttacgttaacgtcgtaccctaacctttcctaagtaccgtaaaccgtaaccgtaccggtccttaacggttaaggtttacgtttcgggtccgtttacgggttcccggggacccgggggtacccgggtaaacccgttaacgggtttacccgg

SEQ ID NO: 283235 - DNA, 753 bp, Homo sapiens
  misc_feature: GYAE6OF01D1DUX.8.53.E09.1.454.CMB.1.raw
  modified_base (354)..(354): a, c, t, g, unknown or other
  misc_feature (354)..(354): n is a, c, g, or t
  modified_base (405)..(405): a, c, t, g, unknown or other
  misc_feature (405)..(405): n is a, c, g, or t
tcagctcgcgtgtccacgaccggtgctcgatttagagagagtgtgttgggtttgggggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactcgtcggggccccagggcaggagggtcctccatcctcctgcacgtgggagacagaaccagcaggtccggggactaggttatgtattgttctagttcggtaccgcgtacggttccgaggccaccgaccgccccagtacctccgtactaattaacngaaactaaaccaactaacgtccggccctaggtacgggtctcgacgaccgtnttcctcgtcgtaccctacgtaagtccgtacggtcctaccttccgtccgtcccgttcccgtgtacccttattacgttccgttcgggttccctaccggggtaaggggttacggtaggtaacggtcgggtaacggtaccgtttaaggtttaacgttttaaccgtttaccgtaccggtaccccttacgttaccccgttaagtaacccgtaaaaccgtaacccggtacggtttaccccggtttaggtttaaaccgggttttacggtttccggggttccgggttttaccggggttacccgggggaccccggggttaaacccgggttaacccggttaacggggtttacccccggg

SEQ ID NO: 283236 - DNA, 589 bp, Homo sapiens
  misc_feature: GYAE6OF01D328H.8.53.E09.1.454.CMB.1.raw
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcagaggtctccatctcctgcacgtgggagcagaaccagcagtcggggcaggttatgattgttcagttggtacccgccgtaggtttccagggtcacgacgcccccagacctcctnaattaangtaactaacaacaacgtccggccctcgacggggtctcgtcgaccgtnttcnctcgcctaccaagttcngctacttcgtcgtccctccgtgtcattatcgtgtctcgnggtgagntgagntgtacttagttacngtaccacgttctagtcgaaccaacgtacgtcccgttagtacgtttagtttgggtaccgttcgggttaccgggccgggtacccgggtaacccgtaaggtttccggtaaccccgttcccggtaaacccgg

SEQ ID NO: 283237 - DNA, 656 bp, Homo sapiens
  misc_feature: GYAE6OF01BR0JR.8.53.E09.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (516)..(516): a, c, t, g, unknown or other
  misc_feature (516)..(516): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcacgcccgcctcagtactcgtcggggccccagggcaggaggtctccatctcctgcacgtgggancagaaccngcagtcggggacaggttatgattgtctagttcggtaccgccgtacggttccaggaccaccgtaccgcccccaagtacccttcctactaatttaaacaggtaaacttaaaccaaacctaacgtcccggtacccgtcggtaacggggtcctaccgtacgacccgttactttcctacgtcgaccctacctaacggtcgtaggcctacgtttccgtcgtcccttcccgtggtactaagttctcgttcggtctccggtagggtgaaggngtacggacgtctagttacttacgttacgcgtacctacgtacctagtaccgaaaccacgtacgtccgttaaggtacgttacgtttcggacggtttcggttacccgggacggggttaccggtaaccgtagggttaaccccgg

SEQ ID NO: 283238 - DNA, 692 bp, Homo sapiens
  misc_feature: GYAE6OF01B8KU4.8.53.E09.1.454.CMB.1.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccaggggcaggagggtcctccatcctcctgcacgtgggancagaaccngcagtcgggctaggtatgattgttcgagttcgggtaccnccgtacggttccacggcacgaccgaccccagacctcctacattaactgaactaacaacaacgtccggacccttggtacggggtactccgtacggtacccgtattcctcgtcgcccttacgtaacgtcgtcggaccttaccgttcgttaccgtccccgttccgttacggtacctacttacgttcgtccgggttaccctccggtacggggtacggtaaggtacgtacgggtaggtaccgttaaggttaacgttttaacgttaacttccggtacccttaccttaccgtaagtaccgaaacctaacgtaccggttacgtacgggttacgtttaccggttgggttcggtttcgggttacggggacccggggtaaccgggttaaccggtaacggtttacccggg

SEQ ID NO: 283239 - DNA, 632 bp, Homo sapiens
  misc_feature: GYAE6OF01CH729.8.53.E09.1.454.CMB.1.raw
  modified_base (248)..(248): a, c, t, g, unknown or other
  misc_feature (248)..(248): n is a, c, g, or t
  modified_base (499)..(499): a, c, t, g, unknown or other
  misc_feature (499)..(499): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactcgtcggggccccagggcaggacgggtctccatctcctgcacgtgggancaacgaaccagacagtcggggactaggttatgatgttctagttcggtaccgccgtacggtcgaggccaccaccgcccccagacccttcctactaattaatacgaaactaaacaactaacgtacccggccctacgacggggttctcgtacggtaccgtattacctctacgtccctaccgaacgttcgtcggaccttacgttccgtcgtcccttccgtagtctattctcgttcgtcgtcggtaggtcgaggtnggacgtctagtacttacttacgcgtacctacttactaagtcgaacctaacgtcgttaccgtaggttacgtttaggttcggtcggttacgggttaccgggaccggggtaccggtaaccggtaggttaccccggg

SEQ ID NO: 283240 - DNA, 714 bp, Homo sapiens
  misc_feature: GYAE6OF01D91JB.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcggggccccagggccaggagggtcctccatcctcctgcacgtgggagcagaaccagcagtcggggctaggttatgtattgttctagtttcggtaccgccgtagggttccaggtccaccgacgcccccagacctccgtactaattaactagaactaaacaactaacgtccggccctacgacgggttctcgtacgacccgtactttcctcttcgtacccttaccgtaacgtccgtcggtaccttaccgtttccgtccgtcccttcccgttcggttacctagttacgttccgttcgggttcctacccggtaggggttcgaacgggtagttacgggaacggttcgtagttaacgttttaacgttaccgtaccgtaccctaccgttacccttaacgttacgaaacctaaccggtacgtcccgttaagggttaacgtttacggttttcgggtaccgttttcggggttacccggggtacccggggttacccgggtaaaccgttacgggtttaaccccgggg

SEQ ID NO: 283241 - DNA, 676 bp, Homo sapiens
  misc_feature: GYAE6OF01ESBIM.8.53.E09.1.454.CMB.1.raw
  modified_base (247)..(247): a, c, t, g, unknown or other
  misc_feature (247)..(247): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtactcgtcggggccccaggggcaggacgggtctccatctcctgcacgtgggancagaaccagcagtcggggcaggttatgatgttctagtttcggtaccgccgtagggttccaggcacaccgcccccagaccctcctactaatttaactgaactaaaccaacctaaacgtcccggtaccctacggaacgggttcctcgtacggtacccgtatttccgtacttcggacccttaccgtaacgttccgtacggtaccttaccgtttccgtccggtcccctttacccgtgggttacctacgtttacgttccgttcggttaccctaccgggtaaggggttagtacgggtagtcgggtaaggtccgttagttaacgtttacgttaccgtcgaccctaacttccgtagtaccgaactaaccgtcgtaccttaggtacgttagttcggacgttcgggtcggaccggggtccgtaacgtacggttacccgg

SEQ ID NO: 283242 - DNA, 814 bp, Homo sapiens
  misc_feature: GYAE6OF01DUUW3.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtcctccatctcctgcacgtgggagcagaaccagcaagtcggggctaggttaatgtaagtgttccagttcggtacccgccgtagggttcccagggcctaaccgaaccggccccccaaggacccttccgtactaaacgtttaaactagaactaaaaccaaacgtaaacgttacccgggaccccttacggtaaacgggggttccctaccgttacggaaccccgtaactttcccgttaccgtcggtaccccttaccgtaagttcccgtacgggtaccttaacgtttccctcgtcccgttacccgttggttaccctaagttaaccgttccgttaccggttaccttacccgggtaaggggttaccgggtaacgggttaacgtggggtaaccggtacgtttacgggttaaactttttaccggtttaaccgttaccgggttaaccctaacccgtttcccgttaacgtaaccggtaaccgtaaaccggtaaccgtaccggttacggttaacgggtttaacgttttcggggtaccgtttacggggtttacccggggaccgggggttaaccccgggtaaccgttaaaccggggtttaaccccggg

SEQ ID NO: 283243 - DNA, 833 bp, Homo sapiens
  misc_feature: GYAE6OF01E52WP.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgacgggtcctcgggcccagtctgtactgacgcacgcccgcctcagtactcggcgggccccgagggcaggacggtcctccactcctcctgacacgtgggacgacaacgaaccagcgacggtcggggactaggtttagtgtacgttcgttactacggttaccggtacccaccggttacggttaccgacggacccaccgaccccgaccccgtaagtaccctccttaactaagttaacgtacgtaaacctaaaccgaaaccgtaccggtcccggtacccgtacgggtaccgggttcctacggttaccggtaacccgttactttcccgtaccgttaccgtacccttaaccggtaacggtccgtacggttacccttactttacccgttcccgtacccgtttaccggtagttaaccttaccggttacgtttcccgggtaccgttaccggtaccgggtaggggtaacggacgggttacggtgggtaaccggttacgtttaagtttaaaccgtttcgttacccgtaccgtaccccgttacttaaccgttaacgtacccgaaacgtacccggttcggttaccggttaaggttaccggttttcgggttcccgggtttaccgggttaccgggggtttacccgggggaaccgggtaacccgggttttaacccggtaaccgggttaaccccggg

SEQ ID NO: 283244 - DNA, 828 bp, Homo sapiens
  misc_feature: GYAE6OF01E3U38.8.53.E09.1.454.CMB.1.raw
tcagctcgcgtgtccacgaccggtgctcgatttagagagagtgtgttgggtttgggggcttcagctgtgggcacaagaggcagcactcaggacaatctccagcatggcctggtctcctctcctctcactctcctcgctcactgcacgacgggtcctcgggcctagtctgtactgacgcacgccgccctcagttactccggtcggggccccaggggccaggtacgggtcctaccgacttccgtccgttgaccgtacgtaggggacgtaccgaacggaaaccgagcgtaacggtccgggggacgtaagggtttagtacggtacttcggtttaccgtaaggtttaccggggtaaccccggtccggtaacgggggtttacccacgggtacccgtaaccgacccggaccccccgtaaggtacccttaccttaactaaacgtttaagtaacgtaaaacctaaacgtaaaccgtaccggttcccggtacccgacggggtacggggttacctacggttaccggtaacccgttacgtttcccgtaccggtacccgtacccgttaaccggtaaacggttccgttacgggtacccttacgttaccctccgtacccttcccggttacgtaactcgttacgtccggttcgggtacgttaccgggagggttacgacggtaggttggtaccggtcttaaggttaacttacggttaactccgtaccttacgtactaacggtcaaccgtacgacgtacggttacgttaggttacgttcgggtaccggttcgggtaccggaccggggttacggtaccttaagggttccgtaacccgtcgtaaccgg

SEQ ID NO: 283245 - DNA, 867 bp, Homo sapiens
  misc_feature: GYAE6OF01BMUW6.8.53.E09.1.454.CMB.1.raw
tcagctcgcgtgtccacgaccggtgctcgatttagagagagtgtgttgggttgggggctctgcttcagctggtgggcacgaagaggcagcactcaggacaatctccagcagtcggcctggtctcctctccgtcctcactctcctcgctcactcgcacgtcgggtcctgggccctagtctgtactggaccgctacgtcccgtcctactaaggttcgtcggtaccgggggccccgtaaggggcaagggtaccggtcctaccgacgttccgtacctcgacgacggtcgggaacgtacgtaacgaaccgacgtacgtaacgggtcggggtacctaaggggtttactaggtatttacgttacgtaacggtttccgggtaaaccgccggttacgggttacccgaacggccctaaccggtaccccgacccccgtaagtaacccgtttcccgtaaacttaacttaagtaaccggtaaaaccttaaaaccgaaccgttaaaccggttccccgggtaacccggttagggtaaacccggggtttcctaaccggtcggaaccgtttaccgtttcgtacccgtaccgtacccgttaccggtaacgtttccggtacggtaccttaccgtttacgtcccgtaacccgttcgtacgtaccagttaccgtcgtaccggttcctacggggacgttaggtaaggtcggtacgtacggttaccgttagttaccgtttaacgtccgtacccgacccgtttactaaccgttacgtaacgtaaacccacgttacccgttacgggttaggttaacgttccggttacgggttaacggttccgggggtacccgggtaccggtaaacccggggttaccgtccgggttaccccgg

SEQ ID NO: 283246 - DNA, 472 bp, Homo sapiens
  misc_feature: GYAE6OF01BF8SD.8.53.E09.1.454.CMB.1.raw
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (445)..(446): a, c, t, g, unknown or other
  misc_feature (445)..(446): n is a, c, g, or t
  modified_base (448)..(472): a, c, t, g, unknown or other
  misc_feature (448)..(472): n is a, c, g, or t
tcagctcgcgtgtccacgaccggtgctcgatttagagagagtgtgttgggtttggggggtgtggtggtctccatctcctgcactgggagcagaaccagcatcggggcaggttatggtgttcattggtaccgccaggttccaggcacagcccccagactcctcattaatgataacaacaatcggccctcaggggtctctgaccgattctctgcctccaagtctggcacttctgccctcctggtcatatctggtctccagggtgaggatgaggctgtattacttatcgccctactcctatgaacaacagcctgagttattggctgttcggcggcgggacctagttcgaccgtctacgtcacgcccaaggcctcgccccctcggtctacctctcgttccccnccctcctcgacncgcgagcgtgacgcgggcnggcaaggcgcatagnngnnnnnnnnnnnnnnnnnnnnnnnnn

SEQ ID NO: 283247 - DNA, 833 bp, Homo sapiens
  misc_feature: GYAE6OF01C39I7.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgccgccctcagtactcgtcggggccccagggccaggacggtctccatcctcctgccacgtgggagccagaaccgacgacgacgtccgggggacgtacgggtttaagtcgtaagttcgttctaggtttcgggtaaccccgtacccgtacgggtttaccgacgggaccacccgaccgtaccccccgaggtaccccttaccctacctaaagtttaaactacggtaaaccttaaaaccgtaaaaccgtaaacgttaccccggggtacccccttccgggtaaacggggtttcccgtacccgttaccggtaacccggtaacgttttcccgttaccgttccgtcccccgttaacccgtaaacggtttcccgttacggtcccgtttaaccgtttcccgttccgtcccctttccccggttagggttaccctaacgtttaccgttacccgtttcggttcccttacccggtaaggggttacggaacgggtacggttggaacggttgttaccgttaacttttacgttaccgtccggtacccttaccgttacctaacgtacgaaccgtaaaccgcgtacgtttacgtagtttacggtttacggtcgttccggggttacccgggtaccggggtaccgggtaacccggtacggtttaccccggg

SEQ ID NO: 283248 - DNA, 801 bp, Homo sapiens
  misc_feature: GYAE6OF01AHG6H.8.53.E09.1.454.CMB.1.raw
  modified_base (192)..(192): a, c, t, g, unknown or other
  misc_feature (192)..(192): n is a, c, g, or t
  modified_base (242)..(242): a, c, t, g, unknown or other
  misc_feature (242)..(242): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctnagtatcgtggggccccagggcagagggtctccatctcctgcacgtgggancaagaccagcagtcggggctagggttatggattgttcacgttcgggtaccgccgtacggttccagggccaaccaccggacccccagtacctcctactaatttaagcggtaaacttaaaccgaaaccgtaacgtcccgggacccctacggtacgggggttaccctcgttaccggtaacccgtactttcccgtcttaccggacccctaaaccgtaacggttccgtacgggtcctaacccgtttccgtccgttccccgttacccgttcgggttacctacgtttacgttcccgttcgggttacccgtaccgggtaacgggggttagtaacgggtacgttacgggaacgggtaccgtttacgggtttaacttttaccggtttaacccgttccggtaaccccttaaccgttacccgttaagtaaccgtaaacccgtaaacccggtaccgttacccggtttaggtaaacgggtttttagttttacccggggtccggtttaccggggtttacccgggggaccgggttaccccgggggttaaacgttaaaccggggttttaccccggg

SEQ ID NO: 283249 - DNA, 747 bp, Homo sapiens
  misc_feature: GYAE6OF01D08ND.8.53.E09.1.454.CMB.1.raw
  modified_base (334)..(334): a, c, t, g, unknown or other
  misc_feature (334)..(334): n is a, c, g, or t
  modified_base (386)..(386): a, c, t, g, unknown or other
  misc_feature (386)..(386): n is a, c, g, or t
tcagctcgcgtgtccacgaccggtgctcgatttagagagagtgtgttgggtttgggggggctctgcttcagctgtgggcacaagaggcagcactcaggacaatctccagcatggcctggtctcctctcctcctcactctcctcgctcactgcacgagggtcctgggccctagtctgtactgacgcacgcccgcctcagtactcgtcggggcccgagggcaggacggtcctccgatcctcctaggcctacggtggggacacgaacgaaccaggacacggtcggggactaggttactagtagttgttactagttaccggaccgcgtacggttaccncgggaccaccggtaccgacccctaagtaccctaccgtactaagttaacgtanaaactaaacaccgtaaccggtcccggtaccttagggtaccggtctacgtacgtaccgttactttcccgacgttacccgtaccgtaaccgtacgttaccgtcggttaaccttcgtttaccctcggttccccttcggtacttacgtacgtttccgtcggttaccgtacgtacgggtacgggtcggaagggtcgtagggtacgttacttaggtttaaccgttacgttaccgtacgttacccttaacgttactaccgtaaccaacgtaccgtaaccgtcggttaaaggttccgttaaggtttccgggtcgtttaccggggtacgggtacccggggtacgtaaacgggttcccggttaaacccggg

SEQ ID NO: 283250 - DNA, 812 bp, Homo sapiens
  misc_feature: GYAE6OF01AF44K.8.53.E09.1.454.CMB.1.raw
tcagctcgcgtgtccacgaccggtgctcgatttagagagagtgtggttggggtttggggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtatccgtcggggccccaggggcaggagggtcctccgatcctcctgccacgtggggagacaacgaaccaggccacggtcgggggactaggtttacaggtacttcggttactagttcgggtaccgccgtacggttccgacggtaccacgaccgtacccccagtaccctccgtacaactttaacgtacgaaacttaaaaccgaaccgtaacgttcccggggaccccgtcgggtaaccggggttctaccgttaccggaacccgttacttttcccgtacgtccgtaccccttaccgtaaacggtttccgtaccgggtacctttaacccgtttcccgtacccggtaccccgtttcccggttacgggtttaccctaacgtttccgtttaccggtcccgggttcccgttaccggggtaaggggttacggaacgggtacgttacgggtacggtcgttaacgggttacctttaacgttacccgtaccgtacccgtacgtttaccctaacggttacgaaacccgtaacgtaccggtacgttaacggttacggtttacggttccggttacggtttcgggttacccgggggaccgggtaccgggtaacccggttaggtttaccccgg

SEQ ID NO: 283251 - DNA, 859 bp, Homo sapiens
  misc_feature: GYAE6OF01EGS8I.8.53.E09.1.454.CMB.1.raw
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
  modified_base (531)..(531): a, c, t, g, unknown or other
  misc_feature (531)..(531): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctcctcctcctcactctcctcgctcactgcacgtacgggtccgtcgggcccagtctcgtactgacgcacgcccgccctagagtacgtccggtccggggaccccgagggccgagggtacggttcctaccgtacttccgtccgtcgaccgtacggtacggggacnccgaaacgaacccgngaccgtaaggtccgggggactaaggtttacgtgtaatttcggttaactacggttaccggggtaacccgtccgttaacggggttcccgaacgggcccaaaccgaccccggaccccctaacggttacccttaccgtaacttaaacttaaacggtacgtaaaaacctaaaaccaaacgtaacccggtccggtcccgtaacgggtaacgggtccttaccgttaacggaacccttnttcccgtacgtccgttacccttaacgtaacgttcgtacgtaccgtttacgttcgttccccggtaccttccgttacggttactaacgtttcgttcgtaccgggttccctagggtacgggttaggtacgtaggtacggtacggtacgttaacgtttacgtttacttaaccggtcccttaccttaacccgtttctaaacgttcccgggaaaccttaaacggtacctaaccggtttggttaaacggttttccgggtttacgtccggggttttccgggtacccggggaacccggggtaaccgggttaaacccggtttccggttaaaccccggg

SEQ ID NO: 283252 - DNA, 783 bp, Homo sapiens
  misc_feature: GYAE6OF01D1UO9.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctctctcctcctcactctcctcgctcactgcacgaggtccgtggcccagtctgtactgacgcgacgcccgcctgagtactcggtccggggccccgagggccaggtacgggtcctaccgattcctccgtcgactacggtggggacacgaacgaaaccgagacgtaacggtcggggacgttaagggtttagtcggtacgtttcgttacgtacggtttaccggacccgtccggtaacggttcccgaacgggacccaaccgtacccggaccccgtaagtacccttacctagttaaagttaacgtacgtaaactaaacctaaaccgtaacgtccccgggtaccgtacgggtaacgggttccttacggtaccgtaaccgttcttcgtacctacgtacccgttacgtaagttccgtacggtaccttaccgttaccgttcccgtaccctccggttataccttacgttcgttccggttcgtccgtacgggttacgggtacgaacggtacgtacgggttacgtacgttacgttaactttaaccgtaccgttaccgaccttaccgttaagtacgaccgtaacgaaccgttacgtcgttaaggtttaacggtttggttccggacggttttccgggaccgggtaacccgggtaccggttaacgtacggtttaccccgg

SEQ ID NO: 283253 - DNA, 748 bp, Homo sapiens
  misc_feature: GYAE6OF01CTBK9.8.53.E09.1.454.CMB.1.raw
  modified_base (448)..(448): a, c, t, g, unknown or other
  misc_feature (448)..(448): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgccgccctcagtactcgtcggggccccagggcaggacgggtcctccgatcctcctgcgacgttgggagacgacgaaccgacgcgacggtcggggactacggttatggtacgttcgttacgtagtttacgggtacccgtaccggtacggtttaccgacggtccaaccgaccgcccccgtaacgtcctacctactaattaacgtagtaacctaaactaaccgaacgtccggacccgtacggtaacgggtcctacgtacgtaccgtnttcccgtacgtccgtacccttaccgtaaggtttccgtaccggtaccttaccgtttaccgtccgtaccccgtttcccgtacgttaccttactcgtttaccggtccgtttacccgtaccggtagggtacggacggtacgttggacggtcgttacgttatttaacgttcgtaccgtccttaccgtacgttacaaccggtaaccaaccgtacggttaccgttagggtttacgtttacggtttcggtacggtttcccgggtacggggtaccggtaacccggggtaacttacgggttaaccccggg

SEQ ID NO: 283254 - DNA, 637 bp, Homo sapiens
  misc_feature: GYAE6OF01C5K8S.8.53.E09.1.454.CMB.1.raw
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtggggcccccagggcaggagggtcctccatctcctgcacgtgggancagaaccngcagtcggggctaggttatgtattgttctagttcgggtacccgccgtacggttccgaggccaccgacgcccccagaccctcctacaattaangaactaacaaacacgtcccggtccctcggtacgggtcctcgtacgaccgtattcctctcgcccttcaagttcctacggcctacgttccgtcgtcccttccgtggtctattacgtccgtcgtccttaccggtagggtacgaggtacgtaggacggtacttgttaactttacttacgtccgtacctaccttacctaacgtacgtaaccaaccgtacgtccgttaggtacgtttagtttcggccgtttcgggttaccgggacccgggtacgggtaacccgtacgggttaccccgg

SEQ ID NO: 283255 - DNA, 911 bp, Homo sapiens
  misc_feature: GYAE6OF01B2Z1S.8.53.E09.1.454.CMB.1.raw
tcagctcgcgtgtccacgaccggtgctcgatttagagagagtgtgttgggtttggggcttcagctgtgggcacaagaggcagcactcaggacaatctccagcatggcctggtctcctctcctctcactctcctcgctcactgcacgacgggtcctcgggcctagtctgtactcgacgcacgcccgtcctcgtagtacgtcggtccggggcccgagggcgagggtacgggttcctacctacgttcctccgtcgaccgtaacgggtagggaacgaccgaaaccggaaaccgacggtacggtaccgggtaccggggtattaagggtttaagttaggttaacgtttcggttacgttacggttaccgggaccgttaccggtaccggttccgaacggtaccaaccgacccgaccccgtaacgtaccctacttaacgtaaacttaacgtaacgtaaactaaaccgaaacgtaccggtcccggtaaccggttacgggtaccggggttctaaccgttaccggtaacgtttacctttaccgtacccgtaaccggttaccccttaaccggtaacgtttacggacccgtttaacctttcccgttccgttaccccggtaccccgtttcgttaacgggttcctaaacggtttccgttacggtttacccgggttacgtacggggtacggggttaccgaaggggttacgtcgggtaacgtttcgttaacgtttaaccttttaccggtaaaccggttccctaacccgttaccttaacgtaacgtaaccgtaaccgttacgccgtttaaggtacggttacggttttacggtcccggtttcggttacccgggggtacccggggttacccgggaaacccgggtttaccgttaaccggggtttaacccgtacccgggttaaccccgtaccgg

SEQ ID NO: 283256 - DNA, 774 bp, Homo sapiens
  misc_feature: GYAE6OF01DHW7U.8.53.E09.1.454.CMB.1.raw
tcagctcgcgtgtccacgaccggtgctcgatttagagagagtgtgttgggtttgggggcttcagctgtgggcacaagaggcagcactcaggacaatctccagcatggcctggtctctctcctcctcactctcctcgctcactgcacgacggtccgtgggcccaggtctggtactgacgcgacgcccgccctcaagtcgtcggtcggggccccagggcagggtacgggttcctctactcctccgagccgtacggtgggacgacaacgaaaccgaggacacggtcggggacttaggttagtgtacgttcgttacgtacggttacggtacccgacggtaccgggtttaccgacgggtaccaaccgacccgacccccgtaaggtaccctaccctactaaattaataacgtaaacgtaaaccaacgtaaaccgtcccggacccgttcgggtacgggttcctacggtaaccgtaccgttacgtttcctaccgtaccgttaccgtaacccgtaacgttccgtacgggtaccttaccggttcccgtccgttacccccgttccggttaccggtacttaacgttacgttcggttcgggttaccgtacgggtaggggtacgtaagggtgtacgggtaacggttccgttaagttaacctttacgttaccgtaccgtacctacttacgttacggactaaccgtccgacgtacgtagttacggttgttaggttccggttacgggccggtaacgggacggttacacggttccggtcccgtacgtcccgg

SEQ ID NO: 283257 - DNA, 870 bp, Homo sapiens
  misc_feature: GYAE6OF01DHGW1.8.53.E09.1.454.CMB.1.raw
  modified_base (107)..(107): a, c, t, g, unknown or other
  misc_feature (107)..(107): n is a, c, g, or t
  modified_base (141)..(141): a, c, t, g, unknown or other
  misc_feature (141)..(141): n is a, c, g, or t
  modified_base (819)..(819): a, c, t, g, unknown or other
  misc_feature (819)..(819): n is a, c, g, or t
tcagctcgcgtgtccacgaccggtgctcgatttagagagagtgtggttggggtttggggggctctgcttcagctggtgggcacaagaggcagcactcaggacaatcnccagcagtcggcctggtctcctcctcctcctacnctcctcctcgctacactcgccacggtcgggtccgtcgggacccagttcctaggtacctcggacgtcaccggtccccgtccctagagttacgtccgggtcccgggggaccccgagggggcgtaacgggtacgggttccctcctacgttcccttccgcgaaccgaacgggtggggaacaccgaacgtaaccacggtaccgaaccggggttcggggacgttaagggttagtaggtacgttaacggtaacgtacggtttaacggtaacccgaagtccgttaaacggttaaccggaaaccgggaaaaacccccggtcccccggtactttcccctttaacgttttaacggttttttaaacgaaacccggtaaacgtccgtccccgtaccccggttacggggtaacccgggtcccgtacgtacccggttcttaccgttccggtacgtccgtaccgtcggttccgcgttccgtcctcgtccgtccctccggtacgacccgtcgtccggtcgtccggtacctacccgtaacggttaacggtaaccgttaggtttaggtttaacgggtttttaactcggacgttcgaacggttacccggttacgaaacttccggtagttccgaccgggtcggttccgggtcccgggtcggttaccggggacccggtacgggtaaactcgggttacccncgggttaccgtacgggactcgaacccggcccgttagggccccgtaccccgg

SEQ ID NO: 283258 - DNA, 722 bp, Homo sapiens
  misc_feature: GYAE6OF01AGXX8.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgacgggtcctgggcccagtctgtactcgacgcacgcccgaccctcagtactccgtcggggccccagggcaggacggtctaccactcctcctgcacgtgggacacacgaccagccgaggtcgggactaggttactgtaactgttactacgttcggtaccgaccgtacggttccgaggaccaccgtacccgacccccaagtaccctacctactaattaacgtacgaaactaaaccaaccgtaaaccgtccggtacccgttcgggtacgggttcctaccgtacgtaacccgtcgtttacccgtccgttaccggtaccccttaccgtaacggttccgtacccggtacttaccccgtttccgtccccgtccccttcccggttacgtaccttaacgtttcgttaccgtcggttacccgtaccgggtagggtagacggttacgtggtacggtaccttagtaactttactcgtaccgtaccttacgtactagaccgaacacggtcgtacttaggtacgttacggttcgccggttacgggtacgggtaccgggaccggtaacggttcggttaacccgg

SEQ ID NO: 283259 - DNA, 710 bp, Homo sapiens
  misc_feature: GYAE6OF01DE07E.8.53.E09.1.454.CMB.1.raw
  modified_base (680)..(685): a, c, t, g, unknown or other
  misc_feature (680)..(685): n is a, c, g, or t
  modified_base (687)..(702): a, c, t, g, unknown or other
  misc_feature (687)..(702): n is a, c, g, or t
  modified_base (704)..(710): a, c, t, g, unknown or other
  misc_feature (704)..(710): n is a, c, g, or t
tcagctcgcgtgtccacgaccggtgctcgatttagagagagtgtgttgggtttggggggtgtggtggtctccatctcctgcactgggagcaagaaccagcagtcggggcaaggttatgattgttcattggtaccgcaggttccaggcacacgcccccagacctcctctattaatagaataaacaaacaacgttcccggccctacgaggggtctcgtcgaccgtattcctcgtcgccctacgaagtccgtggcctacttccgtcgtcccttcccgtggtccaattcgttcgtcgggttacctccgggaaggggtaggagggtaagtagggtaacgggtccttaagttaagtttttaaacttttacccgtcggtaacccccttacccgttaacccgtaaaggttaccgaacaaaaccgtcgtacgttacgtaagttttcgtttcgggtcggtttcgggtaccggacgggtacccgggtaacgtaaggttacggtacccctaccggttaacgccgtaacggaccgtaccggccgttacccgcccccgttcgtacctaccgttccgtttaccctttaccccccgaccccgtttcgaaccccgggaacgaccgggtacccgtaacgggttccgaagggtccggggtaccggggcgtaagggtacgaacggcgtacgtatacgggnnnnnntnnnnnnnnnnnnnnnnannnnnnn

SEQ ID NO: 283260 - DNA, 721 bp, Homo sapiens
  misc_feature: GYAE6OF01CYPQC.8.53.E09.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (442)..(442): a, c, t, g, unknown or other
  misc_feature (442)..(442): n is a, c, g, or t
  modified_base (541)..(541): a, c, t, g, unknown or other
  misc_feature (541)..(541): n is a, c, g, or t
  modified_base (553)..(553): a, c, t, g, unknown or other
  misc_feature (553)..(553): n is a, c, g, or t
  modified_base (625)..(625): a, c, t, g, unknown or other
  misc_feature (625)..(625): n is a, c, g, or t
tcagctcgcgtgtccacgaccggtgctcgatttagagagagtgtgttgggtttggggggctctgcttcagctggtgggcacaagaggcagcactcaggacaatctccagcagtggcctggtcctcctcctcctcctcactcctctcgctcacgtgacacgacgggtccgtcgggccctagtcttgtacgtgacgcgacgcccgcctnagtacnccggtccgggacccgagggaccgaggtaccggttcctaccacgttccctcgtacgacgtacggtacggggacaccgtaacgaaccgtacggcgtaacgggtccggggtaacttaaggttattacgtagtttcggttacgtacggttttacccgggaacccgcgttacgggtaccgaacggtacccgacccgacccgccccgtaagttccctactacgtaaagtttacgngtaactacgaaacctacgtacggtcccgaccgttcggtaccggtcacggtaccgtactccttactcctacgtcctaacgcgttcgcgtactccgttccnccgttctcgttntactagtcgttacgtcgtacgttacgggtggagtctagtccgggtatttacgtaagttacttcgtacccgtntaacccgttcgtacaagtccaaacgtccgacggttgtaggtttacggttagttcggtcccggtttcggacggggaccgggtacgttaaccgtcggg

SEQ ID NO: 283261 - DNA, 744 bp, Homo sapiens
  misc_feature: GYAE6OF01DEGOE.8.53.E09.1.454.CMB.1.raw
  modified_base (626)..(626): a, c, t, g, unknown or other
  misc_feature (626)..(626): n is a, c, g, or t
  modified_base (682)..(682): a, c, t, g, unknown or other
  misc_feature (682)..(682): n is a, c, g, or t
  modified_base (692)..(692): a, c, t, g, unknown or other
  misc_feature (692)..(692): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactcctcctcgctcactgcacgacgggtcctcgggcccagtctgtactgacgcacgccgcctcagtactcgtcggggccccagggcaggacggttcctaccacttcctccgtgaccgtacgtggggacaccgaacggaaccacggactaacggtccgggggtactaggtttataggtattcgttacgtaggtttaccgggtacccgtaccggttacggttcccgaacggtccaacccgtacccgcccccgaaacgttcccttaccctaacttaaacgtttaacgtacggtaaaacctaaacgtaaaccgtaaccgttccccgggcccgttaacgggtaccggggttcctaccgtaccggtacccgttaatttccgtaccgttccgtaccccgttacgtaacggtccgtacggtacctaccttccgtaccgtcccttacgtcgttactacttacgttccggttcgtaccgtccgggttaaggtcggtacgggtntacgggtacgtcgtagttacttactaccgtccacctacgtcctaagacaacgtacncgtacggttnttagttagttcggtccgttcgggtccgggacgtaccggtacgtggttacccg

SEQ ID NO: 283262 - DNA, 683 bp, Homo sapiens
  misc_feature: GYAE6OF01B3ATO.8.53.E09.1.454.CMB.1.raw
  modified_base (134)..(134): a, c, t, g, unknown or other
  misc_feature (134)..(134): n is a, c, g, or t
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
  modified_base (523)..(523): a, c, t, g, unknown or other
  misc_feature (523)..(523): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcnctctcctcgcctcactgcacacgggtcctgggcccagtctgtactgacgcacgccgccctnagtactccgtcgggcccagggcgagacgggtcctccactcctccgngcacggtgggacacaagaaccagcgaggtcgggactaggttactgtattcgttctagttccggtaccgccgtacggtccgacggacccgaccacccgacccccgaagttaccccgtccttactaatttaagtacgtaaaactaaacgtaaactaaccgtacccgggtaccccgtacgggtacgggttcctaccggtaccgtacccgttacgttacccttcgtaccgtacccttaaccggtacgtccgtacgtccttacgttcgtacccgtcccttaccggtntaccgttacttcggtcgtccgtaccgtcgtaggggttgagttgtcggacgtacttggttaactttacgtccgtcaccttctactaggacctaactaccgtagtacttaggttacgtttgtcggtaccgttgggtccggacgggacgtacgtccggttacg

SEQ ID NO: 283263 - DNA, 825 bp, Homo sapiens
  misc_feature: GYAE6OF01CZF84.8.53.E09.1.454.CMB.1.raw
  modified_base (259)..(259): a, c, t, g, unknown or other
  misc_feature (259)..(259): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctctctcctcctcactctcctcgctcactgcacgaggtcctgggcccagtctgactgaccgcgacgccgcccctgagtactccgtcggggaccccctaggggccagggtacggtcctaccgactcctcctgcacgtggganacgacgaaccgtagacgtaacggtccgggtactaaggtttagtacggttaagttcggttacctaacggtttccgggaaccccgtcgtacgggttaccgacggtaccaccgacccgacccccgtagtacccttcctacgtaagtttacagtaaactaaccaacgtaaccgtcccggaccttacggtacgggttcctacgtaccggtaccttacttcccgtgtaccgtcctacgtaacgtccgtacggtaccttaccgttcctacccgtttcccgtacccgttacgttaccgtaacgtttaccgtacccggtttcggtacccgttaccggggtaacgggttacgtacgggtaaggttaccgggtacgttaccggttagtttaaccgtttacgttacccgttacccggtacctaacccgtttacgttaaacgtacccgtaaaccgttaaccggtaccggttccgttaaagggttaccgttttaacgggtttcgggttacccggtttccgggtaccccgggggtacgggtttacccggggtaaacccgttttacggggttaacccccggg

SEQ ID NO: 283264 - DNA, 707 bp, Homo sapiens
  misc_feature: GYAE6OF01B2UTT.8.53.E09.1.454.CMB.1.raw
  modified_base (154)..(154): a, c, t, g, unknown or other
  misc_feature (154)..(154): n is a, c, g, or t
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (473)..(473): a, c, t, g, unknown or other
  misc_feature (473)..(473): n is a, c, g, or t
  modified_base (500)..(500): a, c, t, g, unknown or other
  misc_feature (500)..(500): n is a, c, g, or t
tcagctcgcgtgtccacgaccggtgctcgatttagagagagtgtgttgggtttgggggcttcagctgtggcacaagaggcagcactcaggacaatctccagcatggcctggtctcctctcctcctcactctcctcgctcactgcacagggtccncgggccagtcttgtactgacgcagcccgccctcgagtactccgtcggggcccccaaggggctaggacgggttcctaccgatcctccgtcggacctacgtgggacaccgaacggtaaaccnggcgacggttccggggacgtagggtttancggtaattcggttacgtagttacggtacccggtaccgtacggttaccgaggtccgaccgtaacccgtccccggtagtacccttaccgtactaaatttactacggaacttaaaccgaaaccgtacgtcccggaccgttacggacgggttccacgtcggtactactcgttcncgtacctcgagtcgtagcctacgttcncgtaccgtcttagcctattacgtcgttcgttacgacggtagggtacggtagacgtaggactgttcttaagttcgtacctacgacgttaccttgtaactgaaaccgtacgccgagttacggtaaagtttcgttacggcccgggtttccgggtaacggtccggggtaacccgtaactaagggtttccccgacccttaacgggttacccg

SEQ ID NO: 283265 - DNA, 726 bp, Homo sapiens
  misc_feature: GYAE6OF01D77S2.8.53.E09.1.454.CMB.1.raw
  modified_base (137)..(137): a, c, t, g, unknown or other
  misc_feature (137)..(137): n is a, c, g, or t
  modified_base (618)..(618): a, c, t, g, unknown or other
  misc_feature (618)..(618): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcnctcactgcacgagggtcctcgggcccagtctgtactgacgcacgcccgccctcagtactcgtccggggccccagggccgaggacgggttacctccattcctccgtcgaccacgtagggagaccaaacgaccagccgaggtcggggacgtaggttactgtattcgttctagttcgaccgccgtacggttccgaggtccaaccgacccgacccccgagtacccttaccttacgtaaattaacgtacgaaactaaaacccgtaataaccggtcccggtaccccttacgggacggggtttacctcgtaacggttaacccgtctttacgtccgtcgtacccgtacccgtagtccgttcggccttacgttccgtcctcccgttcccgttagtcctaagtttactccgtacgggttctaccgggtagggtggaacgtacggtcggtacgttcgtaagttatttacgtacttcgtccttaacgtcctanacgtaaacgcgtacgtacttagggtcgtttagttcggtccggtttgggcccgggaccgggtaccggtaaaccggttggtttaccccggaaccgttcccgtaaaccggg

SEQ ID NO: 283266 - DNA, 825 bp, Homo sapiens
  misc_feature: GYAE6OF01EYS0Z.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcacctctcctcgcctcactcgcacggtacgggtccgtcggggaccctagtcttagtactacgaccgcgacgcccgtccctacaggtactcggtccggggaccccaggggcaagggtcggttccacctacttcctccgtcgactacggtggggaacgacgaaacgaaaccgagacgtaacgggtccggggacgttaaggttagtagtacgtttcgttacttacggttacggtacccgtaccggtacggtccgacggaccgaccgacccggaccccaacgtccctacctaccttaaagttaaacgtacgtaaaacttaaaaccaaacgtaaccgtacccggacccgttacggacggggttacctacggtacggtacctaacgtttcctccgttacgacccttaacgtagttcgtaccgacttccgttacgtccgttcccgttcgtgtaccttattacgttcggttcgtcccggtaccggagggggtacgtaggtacggtcggtacggtacttagttaaacttttaaccgtcgtaccgtacccttacgtaaccttacgaaaccgaacccgtaaacgtccgggttaacgttaacggttaacgttttaaccgggttacggtttccgggtttacgggggtaacccggggttaccccgggggtaaccccgggttaaagttaaccggggttaacccccggg

SEQ ID NO: 283267 - DNA, 828 bp, Homo sapiens
  misc_feature: GYAE6OF01DESMR.8.53.E09.1.454.CMB.1.raw
tcagctcgcgtgtccacgaccggtgctcgatttagagagagtgtgttgggtttgggggcttcagctgtgggcaacaagaggcagcactcaggacaatctccagcatggcctggtctcctctcctcctcactcctcctcgctcactgcacgagggtcctgggccctagtctgtacgtgacgcacgcccgccctcgagtacgtccgtcgggggccccaggggcacgggacggtctccatcctcctgctacggtgggacgcaacgaaccgagccgaaggttccggggacgtaagggttataggtacgtttgttaccgtagtttacgggaccccgtacccgtaacgggtttaccgacgggacccaaccgaacccggtacccccgacggtaacccttacccttacgtaaattttaaagtacgtaaaacctaaaccaaacgtaaccgtaccccgggtaccccgttacgggtaaccgggggttccttacggttaccgtaaacccggtttctttcccttcgttacccggtcccttaaccgtacggttcgtacggtacctccctttaccgtccgttaccccgtccgttcggttcttaacttcgttcccgggttaccggtaccgttaccgggtacgggttaggtacgggtacgtacgggtaccgggtacttaacggtttactttaccgttacccgtccgtaccccgttaaccttttactacgtacgtaaacctaccggtacgttaccgtaggttaccggtttacgtttgggttccgtaccgggttcggaccgggttaccggaaccgggtacgttaccggtccggttacccgtacccgg

SEQ ID NO: 283268 - DNA, 826 bp, Homo sapiens
  misc_feature: GYAE6OF01BXWV1.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctcagcatcggcctggtctcctctcctcctcactctcctcgctcactgacacgacgggtccgtcgggccctagtctacgtactcgaccgcaccgcccgtcctacgacgttacgtccggtaccgggggaccccgaggggaccgtaagggtaccgggttccctaccgtacttccgtaccgtggaccgtacggtacggggacgaccgaaacgaaccgacgtacggaacgggtcggggtacgttaggtttagtacggttacgttacggttacgttacggttaccgggtacccgtaccggttacggtaccggacggacctaaccgacccgaccccgtaacgtaccttaccgttaaacttaacgtaacgtaaccgttaaaactaaaccgtaaaccgtaacccggttcccggaaccggttaccggggttaccgggttaccctttaccggtaaccggttacccgtttaccgtttccgtaaccgtttcccggtacccgtttaacgtaacggtcccggttacgttaacccttcgttacccgtccgtcccttacggtaccgttactactacgttcgtaccggtcgtacgggtacggacgtacgtcgtacggacgttacgtacttacgttaccgtcgtacctacctacgttacgtaacgacgtacccgagtccgttagtacgttacgttcgttacgttcggtacggggacggacggttaaccgacgttcggtacccg

SEQ ID NO: 283269 - DNA, 660 bp, Homo sapiens
  misc_feature: GYAE6OF01EB2SI.8.53.E09.1.454.CMB.1.raw
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggccaggagggtctccatcctcctgcacgtgggagcagaaccagcagtcggggcaggttatgatgttctagttcggtaccgccgtaggttccaggcacgaccgcccccagacctcctactaattaatcgaactaaacaacgtaaactccgggcccctacgtacggggtcctacgtacggacccgtactttccgtcttcgtcccttaccgaacgttccgtcgggtcctacgtttccgttccggtcccttcccgttgggtacctacgttacttccgttcgggttccttccggtaggggttcgagggtacgttggacggtccttagtattttaacgttaccgtcgtaccctacttacctacgtacgaacctaacgacgtccctaggttacgttagtttcgggacgttcgggttaccgggccgggtaccgggtaccgtacggttaccccggg

SEQ ID NO: 283270 - DNA, 750 bp, Homo sapiens
  misc_feature: GYAE6OF01BAAEM.8.53.E09.1.454.CMB.1.raw
  modified_base (144)..(144): a, c, t, g, unknown or other
  misc_feature (144)..(144): n is a, c, g, or t
  modified_base (191)..(191): a, c, t, g, unknown or other
  misc_feature (191)..(191): n is a, c, g, or t
tcagctcgcgtgtccacgaccggtgctcgatttagagagagtgtgttggggtttggggggctctgcttcagctgtgggcaacaagaggcagcactcaggacaatctccagcatggcctggtctcctctctcctcactctcctcnctcactgcacgcgggtcctcgggcccagtctgtactgacgcacgccncctcgagtactcgtcggggacccgagggcgaggtacgggtctccgtatcctctcggcacgtgggacacgaacgaaccagacgacggtcggggactaggttatgaattcgtaactggttcggaccgcgtacggtccaacgccacgaccgcccgagacctacctacgtaactaacgtacgaaacttaaacaacgtacgtcccgggtcctacgggtacggtacctacgtacgtaccgttacttctaccgtccgacccttacgtaccgtcggtaccgtacttacccttcgttacccgtcccttccggtacgtacctacgtttacgtttccggtcgttacccgtacgggtaagggtacggtaacgggtagtacgggtacggttctaacggtttacctttaacgttaccgggtaccttaccgaaccgtttactaacggtacctaaaccgttacgggtacgttaacccgttggttaaaccgggttttccggtttaacgggttccggttacggggtacccgggtaacggggttacccggtaaaccggtttaacggggttacccccgg

SEQ ID NO: 283271 - DNA, 760 bp, Homo sapiens
  misc_feature: GYAE6OF01B19O8.8.53.E09.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacgagggtcctcgggcccagtcctgtactgacgcagcccgccctcagtatccgtcgggggccccagggcaggagggtcctccatcctcctgcacgngggacncaacgaaccagcagtcggggactaggttatgatgttactacgttcggtacccgccgtacggttccgaggccaccaccggtacccccagtaccttccctataattaatacgaaattaacgaaacctagtcccgaccgtacggtagggtcctacgtacgtaccgtatttccgtcttacgccctacccgtaaggttccgtcggtaccttacccgtttcgtcccggtaccccgttcccgttaggtacctattaccgttccgttcggttaccgttaccggtaggggttaggtaaggtacggttagggacggttacgttacggttaattttacccggtttaccgtaccgtaccccttaaccgtttacccttaaccgttacgaaacccgtaacgttacggtacccgtttagggtaaacgttttcgggtttacgggtccggtttcggggtacccggggtaccgggtaccccgggtaacgttaacgggtttcccccgggtaccccgtttacccggtaacccg

SEQ ID NO: 283272 - DNA, 727 bp, Homo sapiens
  misc_feature: GYAE6OF01A8THK.8.53.E09.1.454.CMB.1.raw
  modified_base (270)..(270): a, c, t, g, unknown or other
  misc_feature (270)..(270): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagctcgcgtgtccacgaccggtgctcgatttagagagagtgtgttgggttgggggctctgcttcagctgtgggcacaagaggcagcactcaggacaatctccagcatcggcctggtacctccttctcctcctacactctcctcgctcactcgacacgtacgggtcctgggccctagttctcgtactcggacgcgacgcccgcctctagtactcggtcggggaccccagggccaggaggtcctcacgtctcgtgactacgtacgggacncaacggaacacgtacgacggtacggggactaaggttagacgtacgttagtaccacggttaccggtaccgcgtacggtaccacggaccacgttccggaccccgagtacccttactaataaacgtagtaacaacgtaaaacactacggccgactcgacgggtcncgtacgactnttctnaccgtcctactaagtcgtaccgtntaccgttcgacccgtcccttacggtcgtactacgttctaccggtttcgtaccgaacggtacggtagtacgggacgtacgaaggttcctaagggtaacctttacgtaacggtacccgtaacgttaccggtacttaaacgggtaccaaacggttaaacgtaccggtacttaacggggttaacgttttaccggtacggttaaaccggttcgggttacccgggtaaccgggtaacccggtaaagttaccggttaacccgg

SEQ ID NO: 283273 - DNA, 760 bp, Homo sapiens
  misc_feature: GYAE6OF01C9EHQ.8.53.E09.1.454.CMB.1.raw
  modified_base (149)..(149): a, c, t, g, unknown or other
  misc_feature (149)..(149): n is a, c, g, or t
  modified_base (622)..(622): a, c, t, g, unknown or other
  misc_feature (622)..(622): n is a, c, g, or t
tcagctcgcgtgtccacgaccggtgctcgatttagagagagtgtgttgggtttggggggctctgcttcagctgtgggcacaagaggcagcactcaggacaatctccagcatggctggtcctctctcctcctcactctcctcgctcgacngcacgacggtccgtcggccctagtctgtactcgacgcgaccgtccgccctgacgttacgtccggccggggaccccgagggccgagggtaccggtcctaccgtacttccgtcctacggaccgtaccggtaggggaacaccggaacggaaacccgtaggacgaccgggtcgggacggttaaggttacgtagtagttacgtacgttacggttaccggaaccgtaccgttacggtaccgacgaccgtaaccgcccgaaccccgtatacccgttaaccttacgtaaactttaacgtaaagaaaccgttaaaacaaccggtaaacgtttccccggtacccgtagggtaacggttacctcggaaccgttaccgtcttttacgtaccgtaccgtaccgtaccgtacgttccgtacgtccttacgttcccgtacgttcccgttcgtacgttctaacgttccgtcgtaccggtacgttacggnggtagtacgtaggtacgttagtacgttacgttagtacttacgcccgttactacgtactaacacggaactacggtacgagttagttcgttacgtcggttacggtcgggaccggtagggaacccgtgtacccgttaccgg

SEQ ID NO: 283274 - DNA, 171 bp, Homo sapiens
  misc_feature: GYAE6OF01D0ECI.8.53.E09.1.454.CMB.1.raw
  modified_base (167)..(171): a, c, t, g, unknown or other
  misc_feature (167)..(171): n is a, c, g, or t
tcagctcgcgtgtccacgaccggtgctcgatttagagagagtgtgttgggtttggggggtgtggtggtctccactcccgccttgacggggctgctatctgccccctcggtcactctgttcccaccctcctcgacacgcgagctgagcgggctggcaaggcgcatagnnnnn

SEQ ID NO: 283275 - DNA, 793 bp, Homo sapiens
  misc_feature: GYAE6OF01BS08M.8.53.E09.1.454.CMB.1.raw
  modified_base (668)..(668): a, c, t, g, unknown or other
  misc_feature (668)..(668): n is a, c, g, or t
tcagctcgcgtgtccacgaccggtgctcgatttagagagagtgtgttgggtttggggcttcagctgtgggcacaagaggcagcactcaggacaatctccagcatcggcctggtctcctctcctcctcactctcctcgctcgactgcacgtacgggtcctgggccctagttctggtactcgacgccgacgcccgccctacgtagtacgttccgccggggaccccgagggaccagggtacgggttccctccacgttcccgtacccgtgaccgtaaccggtggggacaccgtaacgaaccgacgccgtaaggtccggggacgttaacggtttaagtggtaacgttacgttaacgttaacgttaccggttaacccgaggtaaccttaacgggtttaacccggaaaccgggtaaaaccccgccccggtaccttacctactaaagttaacaagtaaactaaaccgaacgtaccggtccgaccgtacggtacggtctacgtaccgtacgtacttcgtcctcccgaccgtaacctcgtacgttcgacgttccttcccgtaacgttccccgtaacgtttcgacttacgtacgttcgtaccgttcggccgtaagggtaggtacggtagtcggacggtcttagttcttacgttaccgcttacccctacgttataccganaccgtaagcgtcgtaggtttaacgtttccgggtaggttaccggtttcggggtaccggtaccgggttaaccggtacccgttacgggttaccctaccccggtttccaaacgggtcccgtaacccggg

SEQ ID NO: 283276 - DNA, 861 bp, Homo sapiens
  misc_feature: GYAE6OF01A0DZ6.8.53.E09.1.454.CMB.1.raw
  modified_base (131)..(131): a, c, t, g, unknown or other
  misc_feature (131)..(131): n is a, c, g, or t
tcagctcgcgtgtccacgaccggtgctcgatttagagagagtgtgttggggtttggggggctctgcttcagctggtgggcacaagaggcagcactcaggacaatctcagcatggcctgtctctctcctccnactctcctcgctcactgcacgtacgggtcctcgggcccagtctagtactgacgcacgcccgtacctactagtacgttcggccggggaccccgaggggaccaagggtacgggttacccaccgtacttcctccgtacggcctaacggtaggggaaccgaaccgaaaccgtaaaccggtaacggtaccggtaaccggggttaccggggtaaccggttaaggggtttaagacggtttaacggtttacgtttacggtaacggtttacccgggggtaacccgttaccggtacggggttacccgaacgggtacccaacccgttacccggaacccccgtacgggttaacccttacccgttaaacttaacgggtttaaacaacggttaaaacctaaaaccggaaaccgttaacccggtcccggtaacccgtacggtaaccggggttcctacggtacgtaccgtacgtttacctccgtacgtacctacggtaacgtcgtaccgtccgttacgttaccgtcgtacccgttacgtacggttacctaacttacggtttaccgtacgggttaccttacgggtagggttaacggaacgggttatccgggttaagtgttaacgtttaagtttaccgttactccggtacctacgttaactacgtaaaccaacgtacgtacgtagttacgtacgggttctggttaccggtgggttacgggaaccggtacggtcgtaaccggttacccg

SEQ ID NO: 283277 - DNA, 746 bp, Homo sapiens
  misc_feature: GYAE6OF01DTAB7.8.53.E09.1.454.CMB.1.raw
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
tcagctcgcgtgtccacgaccggtgctcgatttagagagagtgtgttgggtttggggggctctgcttcagctgtgggcacaagaggcagcactcaggacaatctccagcatgcctggtctcctctcctcctcactctcctcgctcactgcacgagggtcctcgggcccagtctgtactgacncacgccgccctcagtatccggtcggggccccgagggcaggacggtcctccatcctctgcagtgggancaacgaacagcgaggtccgggganaggtttagngtagttcgttagtacgtttccgggtacccgtacgtacggttccgacggacctaccgaccgaccccccgtagtaccctacctactaaacttaagttaaccgaaacttaaaccgaacgtaacgtcccgtaccccggttacggtaccggggttacccttccggtaccgacccgttactttaccgttaccgttacccgtaccccgttaactaaccggtttccgtaccgggttaacccttccgtttacccgtcccgttaccccgttccggttaggtacccttagttacccgtttcgtaccggtcgtaccgggtagggtaggagttacggtggtacgtccggtttagttaacgtttacgttaactccggtaccttcctacgttactacgacgaaccgtcgttagtaggttacgttacgttcggagtttcccggggtacggaccgggtacgggtaaccgtcggttacccgg

SEQ ID NO: 283278 - DNA, 812 bp, Homo sapiens
  misc_feature: GYAE6OF01D65MW.8.53.E09.1.454.CMB.1.raw
tcagctcgcgtgtccacgaccggtgctcgatttagagagagtgtggttgggtttggggggctctgcttcagctgtgggcacaagaggcagcactcaggacaatctccagcatggcctggtctcctctcctcctcactctcctcgctcactgcacagggtcctgggcccagttcctgtactgacgctacgcccgcctcacgtatcgtcggggcccagggcagagggtctccgatcctccgtgcgacgttggggacgacacgaaccgagacacggtccgggggacgtaagggtttacgtagtcgttcgttacgtacgtttacgggtacccggtccgttaacggggtttcccggaagggacccaacgacccggaccccccgacgtacccttccttaaccttaaatttaacgtacggtaaacctaaacgaaaccgtaaccgttaaccggtccccgttacgggtacgggggttacctccggtaccggtaccgttaaccgtttccgttaccgttccggtaccccttaacgtaccggtttaccggtccggttaacctacccggttttccgttacccgtccccgttcccgttaacgttccgttaacgtttaccttccggtttcggtttacccgtacccgggtacggggttacgtaagggtacgtcggtaacgggtctaggttaactttacgttaacctcggaccttacgtccgttacgtaacgtaacctacgtaccggttacgtagttacggttcggtttggtccggttaacgggttcccgggtaccggggtaccgggtacccgttacggttaacccggg

SEQ ID NO: 283279 - DNA, 658 bp, Homo sapiens
  misc_feature: GYAE6OF01A6CFU.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtcctcctctcctcctcactctcctcgctcactgcacgagggtcctgggacccagttctcgccctgactcacgtccctcccctccgccggtccggtctccgtggacagtcagtccaccactcctccgtgacacgtgggacgccagacgtagtgaacttaacaaactatactctccgtacgtaccaaacaaccaccgacggaccaaaccgaccccaaactcaatctagtttgacgtacaagtaacgccgtccgtacggacggtacctaggacttcgtccttcgtacgacgtccctacgaacgtcgtacgtaccaaccgtaccggtccctaccctcggtacccgttcgtccggtaccgggacccttaccaaggtacccgtaggtacggtagtaccggacgggttacctttattaaactttaacgttcgtacgtaccgtacgttccgttaactaagttacgtaccgtagaccaaggtacgaaggtacggtacgtcgggacggtaacgacgtacgacggtacgacgaggtaccgcgtacccgacgg

SEQ ID NO: 283280 - DNA, 816 bp, Homo sapiens
  misc_feature: GYAE6OF01EHLXC.8.53.E09.1.454.CMB.1.raw
  modified_base (154)..(154): a, c, t, g, unknown or other
  misc_feature (154)..(154): n is a, c, g, or t
  modified_base (257)..(257): a, c, t, g, unknown or other
  misc_feature (257)..(257): n is a, c, g, or t
tcagctcgcgtgtccacgaccggtgctcgatttagagagagtgtgttgggttgggggctctgcttcagctgtgggcacaagaggcagcactcaggacaatctccagcatcggcctggtcctcctctcctctcactctcctcgctcactgcacgngggtcctcgggcccagtctgtactgacgcagcccgcctgagtactcgtcggggccccagggccaggacggttcctccgattcctccgtgacgacgtggggacncgacgaaccgaagccgaggtcggggactaggtttagtagtagttgttacgttagtttcggtacccgtaccgtacgggttccgaacggtacaccgaccggacccccgaacgtaacccgttcctacctaaagtttaactacgaaacttaaaccgaaaccgtaaacgggttcccggtacccggttacgggtaacggggttacccttccgtacccggtaaacccgttcttttcccgtcccgtaccggttaccccgttacccggtaaacggtttccccggttacgggtaacccctttaccctttcccgggtttacccgtcccccttttcccccggttacgggtttaaccccgttaaactttacccgttttcccgtttaccgggttcccggtttacccggtacggggttagggtaaccgggttaagtcggggtaaccggtagtttacgggttaaactttacgttacgttccgaccttaccgtactagtacgtaccaagtccggtactaggtaagttcttcggtacgttcggtcgggaccgggtacggtacgtcgggttaacccgg

SEQ ID NO: 283281 - DNA, 777 bp, Homo sapiens
  misc_feature: GYAE6OF01ASMHT.8.53.E09.1.454.CMB.1.raw
  modified_base (232)..(232): a, c, t, g, unknown or other
  misc_feature (232)..(232): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacacggtcctgggcccagtctgtactgacgcacgcccgccctcagtactcgtcggggcccctagggctaggtacgggttccnccgactcctaccgtgacgtacgtgggacgaccaacgaaccaggctaggtccggggactaaggttacgtagtacttacgttacgtacggtttaccggtaccgtaccgtacggtttccgacggtccgtaaccgtacccgtaacccccgtagtaacccttaccgttaaacttaagttaaaacgttacgtaaaccttaaaccaaaccggttaaccgttaccccgggaccccgttacgggtaaccgggttaccttacggtaccggtaccgttaccgtttcctacgtaccgtacccgtaacgttacggtccgttcgaccgttaccttcccgtccgtacccgttccgttacggtactaccgttcttacggttccgtaccgtaccggtaggggtctaacgggtacgtaccggagttaccgttaagttacctttacgtccgtacctaccgtaaccttcggttacgaaccgtacctacgtaccgtcgtttaagtcgtttacggttcgtacggtttccgggacgggaccggttacccggtaacgtaccggttccgg

SEQ ID NO: 283282 - DNA, 725 bp, Homo sapiens
  misc_feature: GYAE6OF01BEPZ1.8.53.E09.1.454.CMB.1.raw
  modified_base (183)..(183): a, c, t, g, unknown or other
  misc_feature (183)..(183): n is a, c, g, or t
  modified_base (691)..(692): a, c, t, g, unknown or other
  misc_feature (691)..(692): n is a, c, g, or t
  modified_base (695)..(695): a, c, t, g, unknown or other
  misc_feature (695)..(695): n is a, c, g, or t
  modified_base (697)..(702): a, c, t, g, unknown or other
  misc_feature (697)..(702): n is a, c, g, or t
  modified_base (704)..(704): a, c, t, g, unknown or other
  misc_feature (704)..(704): n is a, c, g, or t
  modified_base (706)..(711): a, c, t, g, unknown or other
  misc_feature (706)..(711): n is a, c, g, or t
  modified_base (713)..(725): a, c, t, g, unknown or other
  misc_feature (713)..(725): n is a, c, g, or t
tcagctcgcgtgtccacgaccggtgctcgatttagagagagtgtggttggggtttgggggggtgtggtggtctccatctcctggcactggggagcaagaaccgagcagtcgggggctagggttatgatgttcattgggtacccgccgacggttccaggcaacgacgcccccagacctccctanaatttaatgaactaacaacaagtccggccctggaggggtcctctgacccgtatttcctctcgccctaccgaagttccgtggcctacctttcgtccgcccccgttcccgtggtaccattacgttccgttgggttccgtcccggagggggtacggaagggtactaggggagggtcccttaggtaacgttttaactacctcggaacccctacttctaagtcgaaacctaaacgtccggtcgtagttaagggttttacgtttcgggtcgtttcggggttccgggacccggggtacggaacccttaaggttcccggaccccgttacctttacgggtccaacggtacccccgaaggtcccgtcccgtaccccccgggttgtacccgtaccttccccgggttcccggttacccccctcccgttaccccggtaccggaaccgcccgggacgaaccggttccgtacgggcggggtccgggtaccggttacgggacggacgggacgtagacgttaggnngtncnnnnnncngnnnnnngnnnnnnnnnnnnn

SEQ ID NO: 283283 - DNA, 166 bp, Homo sapiens
  misc_feature: GYAE6OF02FF0RU.8.53.E09.1.454.CMB.1.raw
  modified_base (162)..(166): a, c, t, g, unknown or other
  misc_feature (162)..(166): n is a, c, g, or t
tcagctcgcgtgtccacgaccggtgctcgatttagagagagtgtgttgggtttggggtgtggtggtctccactcccgccttgacgggctgctatctgcccctcggtcactctgttcccgcctcctcgacacgcgagctgagcgggctggcaaggcgcatagnnnnn

SEQ ID NO: 283284 - DNA, 165 bp, Homo sapiens
  misc_feature: GYAE6OF02I0LYL.8.53.E09.1.454.CMB.1.raw
  modified_base (164)..(165): a, c, t, g, unknown or other
  misc_feature (164)..(165): n is a, c, g, or t
tcagctcgcgtgtccacgaccggtgctcgatttagagagagtgtgttgggtttggggtgtggtggtctccactcccgccttgacgggctgctatctgcccctcggtcactctgttcccacccctcctcgacacgcgagctgagcgggctggcaaggcgcatagnn

SEQ ID NO: 283285 - DNA, 164 bp, Homo sapiens
  misc_feature: GYAE6OF02GN96Z.8.53.E09.1.454.CMB.1.raw
tcagctcgcgtgtccacgaccggtgctcgatttagagagagtgtgttgggtttggggtgtggtggtctccactcccgccttgacggggctgctatctgccccctcggtcactctgttcccaccctcctcgacacgcgagctgagcgggctggcaaggcgcatag

SEQ ID NO: 283286 - DNA, 165 bp, Homo sapiens
  misc_feature: GYAE6OF02IEKFK.8.53.E09.1.454.CMB.1.raw
  modified_base (164)..(165): a, c, t, g, unknown or other
  misc_feature (164)..(165): n is a, c, g, or t
tcagctcgcgtgtccacgaccggtgctcgatttagagagagtgtgttgggtttggggtgtggtggtctccactcccgccttgacggggctgctatctgcccctcggtcactctgttcccgccctcctcgacacgcgagctgagcgggctggcaaggcgcatagnn

SEQ ID NO: 283287 - DNA, 172 bp, Homo sapiens
  misc_feature: GYAE6OF02GZ9T8.8.53.E09.1.454.CMB.1.raw
  modified_base (164)..(172): a, c, t, g, unknown or other
  misc_feature (164)..(172): n is a, c, g, or t
tcagctcgcgtgtccacgaccggtgctcgatttagagagagtgtgttgggtttggggtgtggtggtctccactcccgccttgacggggctgctatctgcccctcggtcactctgttcccaccctcctcgacacgcgagctgagcgggctggcaaggcgcatagnnnnnnnnn

SEQ ID NO: 283288 - DNA, 169 bp, Homo sapiens
  misc_feature: GYAE6OF02F1Q2D.8.53.E09.1.454.CMB.1.raw
  modified_base (163)..(169): a, c, t, g, unknown or other
  misc_feature (163)..(169): n is a, c, g, or t
tcagctcgcgtgtccacgaccggtgctcgatttagagagagtgtgttgggtttggggtgtggtggtctccactcccgccttgacgggctgctatctgcccctcggtcactctgttcccaccctcctcgacacgcgagctgagcgggctggcaaggcgcatagnnnnnnn

SEQ ID NO: 283289 - DNA, 168 bp, Homo sapiens
  misc_feature: GYAE6OF02GFT1Y.8.53.E09.1.454.CMB.1.raw
  modified_base (165)..(168): a, c, t, g, unknown or other
  misc_feature (165)..(168): n is a, c, g, or t
tcagctcgcgtgtccacgaccggtgctcgatttagagagagtgtgttgggtttggggtgtggtggtctccactcccgccttgacggggctgctatctgccccctcggtcactctgttcccgccctcctcgacacgcgagctgagcgggctggcaaggcgcatagnnnn

SEQ ID NO: 283290 - DNA, 435 bp, Homo sapiens
  misc_feature: GYAE6OF02FRC2Y.8.53.E09.1.454.CMB.1.raw
  modified_base (423)..(423): a, c, t, g, unknown or other
  misc_feature (423)..(423): n is a, c, g, or t
  modified_base (429)..(435): a, c, t, g, unknown or other
  misc_feature (429)..(435): n is a, c, g, or t
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctggtcactctgttcccaccctcctcgacacgcgagctgagcgggctggcaaggcncatagnnnnnnn

SEQ ID NO: 283291 - DNA, 442 bp, Homo sapiens
  misc_feature: GYAE6OF02JXRLM.8.53.E09.1.454.CMB.1.raw
  modified_base (232)..(232): a, c, t, g, unknown or other
  misc_feature (232)..(232): n is a, c, g, or t
  modified_base (393)..(393): a, c, t, g, unknown or other
  misc_feature (393)..(393): n is a, c, g, or t
  modified_base (431)..(442): a, c, t, g, unknown or other
  misc_feature (431)..(442): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaaatgataacaacaatcggccctcaggggtctctgaccgattctctgcctccaagtctggcacttcngcctccctggtcatatctggtctccagggtgaggatgaggctgattattactgccactcctatgacaacagcctgagtatttggctgttcggcggcgggaccaagttgaccgtcctacgtcagcccaaggctgccccctggtcactctgttcccgcctccncgacacgcgagctgacgcgggctggcaaggcgcatagnnnnnnnnnnnn

SEQ ID NO: 283292 - DNA, 525 bp, Homo sapiens
  misc_feature: GYAE6OF02JACY6.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgcaggttccaggcacagcccccagactcctcattaatgataacaacaatcggccctcgagggtctctgaccgtattctctcgcctccaagtctggcacttctgcctcctggtcattactcttggtctccgagggtgacggtatggaggctagtattattactgccctacttccctatacgacaacgacgtcctagtacgttagtttggctttggttcggccgggtacgggtacctaggttaccgg

SEQ ID NO: 283293 - DNA, 504 bp, Homo sapiens
  misc_feature: GYAE6OF02FQJV8.8.53.E09.1.454.CMB.1.raw
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (459)..(459): a, c, t, g, unknown or other
  misc_feature (459)..(459): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgagggtctctgaccgattctctgcctcaagtctggcacttctgcctcccgtggtcatntctggtctccngggtgaggatggaggtctgtatttattactgcccactcctatgaacaacgngcctgagttagttgcttggttccgggcggcgggactagttaccgg

SEQ ID NO: 283294 - DNA, 498 bp, Homo sapiens
  misc_feature: GYAE6OF02HC1F6.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccgagggtgaggatggaggctgatttacttactgccacttcctatgacaacgacgcctgagttatttggcttggttcggcggcggacagttccgg

SEQ ID NO: 283295 - DNA, 643 bp, Homo sapiens
  misc_feature: GYAE6OF02IGD7F.8.53.E09.1.454.CMB.1.raw
  modified_base (288)..(288): a, c, t, g, unknown or other
  misc_feature (288)..(288): n is a, c, g, or t
  modified_base (337)..(337): a, c, t, g, unknown or other
  misc_feature (337)..(337): n is a, c, g, or t
  modified_base (420)..(420): a, c, t, g, unknown or other
  misc_feature (420)..(420): n is a, c, g, or t
tcagctcgcgtgtccacgaccggtgctcgatttagagagagtgtgttgggtttgggggtcgtcgtgcttcagctgtgggcacaagaggcagcactcaggacaatctccagcatggcctggtctcctctcctcctcactctcctcgctcactgcacaggtcctgggcccagtctgtacctgacgcagcccgccctcagtatctggggccccagggccagagggtctccatctcctgcacgtgggagcagaaccagcagtcggggcaggttatgatgttcattggtaccncctaggttccaggccacacgcccccagacctctcattaatgataaacanaactccggacctcgtaacgggtctcgtacgaccgtattccttactcgtccctaccgaacgttccgtaggcctacctttccgtntccccgtttcccgtcgggttactactaacttccgttcggttcctacccggaaggggttggaacgggttagtacggagggtctagttaattaactttccgtacgtaccctaaccgtttccctaatacggtaacctaacgacccgtacctttaggtagttaaaccgttttggtaccgtttcggtaccggggttcccgggaccgggtaaccgttagttaacccggg

SEQ ID NO: 283296 - DNA, 173 bp, Homo sapiens
  misc_feature: GYAE6OF02H12HF.8.53.E09.1.454.CMB.1.raw
  modified_base (166)..(173): a, c, t, g, unknown or other
  misc_feature (166)..(173): n is a, c, g, or t
tcagctcgcgtgtccacgaccggtgctcgatttagagagagtgtgttgggtttgggggtgtggtggtctccactcccgccttgacggggctgctatctgccccctcggtcactctgttcccaccctcctcgacacgcgagctgagcgggctggcaaggcgcatagnnnnnnnn

SEQ ID NO: 283297 - DNA, 437 bp, Homo sapiens; identical to SEQ ID NO: 283195
  misc_feature: GYAE6OF02FTMC1.8.53.E09.1.454.CMB.1.raw
  modified_base (430)..(437): a, c, t, g, unknown or other
  misc_feature (430)..(437): n is a, c, g, or t

SEQ ID NO: 283298 - DNA, 534 bp, Homo sapiens
  misc_feature: GYAE6OF02G8UUG.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatctggggccccagggcagagggtctccatctcctgcactgggagcagaaccagcatcggcaggttatgatgttcattggtaccgccaggttccaggcacacgccccaagactcctcattaatgataaacaacaatcggccctcgagggtctctgaccgtattctctcgcctccaagtctggctacttctcgcctcctgtcatatctggtctccgagggtgaggatggaggtctagtattacttactcgacctactacctatacgaacaacgcgtccttaggaagttacgtttggtcttcgggttccgggccgggtacgggtaccgtaaggttaccgg

SEQ ID NO: 283299 - DNA, 165 bp, Homo sapiens
  misc_feature: GYAE6OF02H17ZD.8.53.E09.1.454.CMB.1.raw
  modified_base (165)..(165): a, c, t, g, unknown or other
  misc_feature (165)..(165): n is a, c, g, or t
tcagctcgcgtgtccacgaccggtgctcgatttagagagagtgtgttgggtttgggggtgtggtggtctccactcccgccttgacggggctgctatctgccccctcggtcactctgttcccgccctcctcgacacgcagctgagcgggctggcaaggcgcatagn

SEQ ID NO: 283300 - DNA, 435 bp, Homo sapiens
  misc_feature: GYAE6OF02F4V73.8.53.E09.1.454.CMB.1.raw
  modified_base (393)..(393): a, c, t, g, unknown or other
  misc_feature (393)..(393): n is a, c, g, or t
  modified_base (430)..(435): a, c, t, g, unknown or other
  misc_feature (430)..(435): n is a, c, g, or t
tcagctcgcgtgtccacgaccggtgctcgatttagagagagtgtgttgggtttggggttgtggtggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtcctggcacttctgcctccctggtcatatctggtctccaggtgaggatgaggctgattattactgccactcctatgacaacagcctgagtatttggctgttcggcggcgggaccaagttgaccgtcctacgtcagccccaaggctgccccctcggtcactctgttcccaccctccncgacacgcgagctgagcgggctggcaaggcgcatagnnnnnn

SEQ ID NO: 283301 - DNA, 503 bp, Homo sapiens
  misc_feature: GYAE6OF02FF22C.8.53.E09.1.454.CMB.1.raw
  modified_base (346)..(346): a, c, t, g, unknown or other
  misc_feature (346)..(346): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcatttggtaccgccaggttccaggcacagcccccagactcctcattatgataacaacaatcgcctcgagggtctcngaccgattctctgcctccaagtctggcacttctgcctccctgtcatatctggtctccgaggtgaggatggngctgattatactncctactctatcgacacgtagcctaggacgttagttcggcttcgggttcggccggacgggtacctaggttaccg

SEQ ID NO: 283302 - DNA, 492 bp, Homo sapiens
  misc_feature: GYAE6OF02I0D16.8.53.E09.1.454.CMB.1.raw
  modified_base (341)..(341): a, c, t, g, unknown or other
  misc_feature (341)..(341): n is a, c, g, or t
  modified_base (457)..(457): a, c, t, g, unknown or other
  misc_feature (457)..(457): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccagggcacacgcccccagacctcctcattaatgataacaacaatcggccctnagggtctctagaccgattctctcgcctcaagtctggcacttctgcctccctggtcatatctgtctcgagggtgaggtatgaggtctgtattattactgccactcctatgacaacgngacctgagtgttgcttgttcggcggcggacagtcg

SEQ ID NO: 283303 - DNA, 576 bp, Homo sapiens
  misc_feature: GYAE6OF02FMKP5.8.53.E09.1.454.CMB.1.raw
  modified_base (192)..(192): a, c, t, g, unknown or other
  misc_feature (192)..(192): n is a, c, g, or t
  modified_base (244)..(244): a, c, t, g, unknown or other
  misc_feature (244)..(244): n is a, c, g, or t
  modified_base (437)..(437): a, c, t, g, unknown or other
  misc_feature (437)..(437): n is a, c, g, or t
tcagctcgcgtgtccacgaccggtgctcgatttagagagagtgtgttgggtttggggggcttcagctgtgggcacaagaggcagcactcaggacaagtctccagcatggccctggtctcctctcctcctcactctcctcgctcgactgcacaggtcctgggcccagtcctgtacctgacgcaggccgccctnagtatctggggccccagggcagacgggtctccatctacctgccacgtgggancaggaaccagctatcgggcaggtatgatgttcattcgtaaccgcaggttccaggcacgagcccccagacctcctcactttaactggactaacaacaatcggccctcaggggtctctcgaccgtattctctgcctccgacgtctggccactttctgcctccctggtcatagtctggtcttcgagggttgaggtntgtaggtctgtatttagttactgtcctacgttccgtagttgaacgtaacgacggtaccgtaggtaaggttacgttttcggccttaggttccgggacggtccgggaaccgtaacggtcggtaccccgtccgttaacccgg

SEQ ID NO: 283304 - DNA, 440 bp, Homo sapiens
  misc_feature: GYAE6OF02IZNXO.8.53.E09.1.454.CMB.1.raw
  modified_base (431)..(440): a, c, t, g, unknown or other
  misc_feature (431)..(440): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttgctgttcggcggcgggaccaagttcgaccgtctacgtcagcccaaggctcgcccctcggtcactctcgttcccgccctcctcgacacgcgagctgagcgggctggcaaggcgcatagnnnnnnnnnn

SEQ ID NO: 283305 - DNA, 510 bp, Homo sapiens
  misc_feature: GYAE6OF02FSFSN.8.53.E09.1.454.CMB.1.raw
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctccctgtcatatctgtctccgaggtgaggntgngctgattattactgcctactcctatcgacaactgcctagtaagtatttggacttggttcgggcggcgggtaaccgtaagttcgacccgtctaaccgg

SEQ ID NO: 283306 - DNA, 541 bp, Homo sapiens
  misc_feature: GYAE6OF02FYR1L.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcagtcggggcaggttatgatgttcattggtaccgccaggttccaggcacgacgcccccagacctcctcattaatgataacaacaactcggccctcgacggggtctcgtcgaccgtattctctcgcctaccaagtctggctacttctcgcctcctgtcatactcgtgtctcgagggtgaggatgacgtcgtagtatttcgttactgcctactcctatcgaactaacgtacgacctagtacgttagtttggtcgttcggttccgggtcgggtaccgggtaccgtaggttaccgg

SEQ ID NO: 283307 - DNA, 165 bp, Homo sapiens
  misc_feature: GYAE6OF02GGH98.8.53.E09.1.454.CMB.1.raw
tcagctcgcgtgtccacgaccggtgctcgatttagagagagtgtgttgggtttgggggtgtggtggtctccactcccgccttgacggggctgctatctgccccctcggtcactctgttcccaccctcctcgacacgcgagctgagcgggctggcaaggcgcatag

SEQ ID NO: 283308 - DNA, 499 bp, Homo sapiens
  misc_feature: GYAE6OF02GRIEW.8.53.E09.1.454.CMB.1.raw
  modified_base (275)..(275): a, c, t, g, unknown or other
  misc_feature (275)..(275): n is a, c, g, or t
  modified_base (469)..(499): a, c, t, g, unknown or other
  misc_feature (469)..(499): n is a, c, g, or t
tcagctcgcgtgtccacgaccggtgctcgatttagagagagtgtgttggggtttggggggtagtggtcgttctccatctccctgcactgggagcagaaccagcatcggggcaggttatgatgttctattggtaccgccaggttccaggcacagccccccagacctcctcattaatgataacaacaatcggccctcaggggtctctgaccgattcgtctgcctccaagtctggcacttctgcctccctggtccatatctggtctccagggtgaggntgaggctggattagttactgccactcctagtgaacaacacgcctgtaagtttatttggcttggttacggcggacgggacctaaggttcgacccgttctacgtcgagcccaaaggctcgccccctcggtccaccttctcgtccccaccctcctccgacacgcgagctgacgcgggctgggacaaggcacgatagnnnnnnnnnnnnnnnnnnnnnnnnnnnnnnn

SEQ ID NO: 283309 - DNA, 446 bp, Homo sapiens
  misc_feature: GYAE6OF02HL4DN.8.53.E09.1.454.CMB.1.raw
  modified_base (319)..(319): a, c, t, g, unknown or other
  misc_feature (319)..(319): n is a, c, g, or t
  modified_base (433)..(433): a, c, t, g, unknown or other
  misc_feature (433)..(433): n is a, c, g, or t
  modified_base (437)..(446): a, c, t, g, unknown or other
  misc_feature (437)..(446): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctcgcctccctggtcagatctggtctccaggggtgaggatgaggctgattattactgccactcctatgacaacagcctgagttatttggnttggttcggcggcgggaccaaggttcgaccgtcctacgtcacgcccaaggctcgccccctggtcactctcgttcccaccctcctcgacacgcgagctgagcggctggacaggcncatnnnnnnnnnn

SEQ ID NO: 283310 - DNA, 726 bp, Homo sapiens
  misc_feature: GYAE6OF02FHYUR.8.53.E09.1.454.CMB.1.raw
  modified_base (357)..(357): a, c, t, g, unknown or other
  misc_feature (357)..(357): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactccgtcggggcccccagggcaggtacgggtcctccatcctcctgccacgtggggacgccaacgaaccagccagtccggggcagggttactgtattggttcagttcggtaccgcgtacggttcaggccaccgacgcccccagacctcctactaacttaangaaactaaccaactaacgtccggaccctacgacgggttacctcgtacgaaccgttacttcctcgtcgaccctaccgaacgtttccgacggtcctaacctttccgtccgtccccttcccgttacggtacctaacgttaccgttccgttacggttacccgtacccggtaaggggttcgaaggttacgtacggaacggtcgttaagttaacgtttaacgtttaccaccgtaccctaccgttacccgtaacgttacgaacccgtaccgtaacggtccgttaacggttaacggtttacggtttacgggtccgtttaccggggttacccggggaccgggtacccggggtaacccgttaacgggtttaaccccggg

SEQ ID NO: 283311 - DNA, 555 bp, Homo sapiens
  misc_feature: GYAE6OF02IT7BL.8.53.E09.1.454.CMB.1.raw
  modified_base (405)..(405): a, c, t, g, unknown or other
  misc_feature (405)..(405): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcggggccccagggcagagggtctccatctcctgcacgtgggagcagaaccagcagtcggggcaggttatgatgttcattggtaccgccaggttccaggcacacgcccccagacctcctcaattaatgaataaacaacaatccggaccctacgaggggtctcgtagaccgtattctctcgccctaccaagtctggctacttctcncccttcctggtcatacttcgtgtcctccgagggtgaggtntggaggtntagtattacttactcgacctacttctatacgaacaacgacgtcctagtacgttagtttggcgttacggttccgggcgggtaccgggtacctaggttacccgg

SEQ ID NO: 283312 - DNA, 165 bp, Homo sapiens
  misc_feature: GYAE6OF02H248N.8.53.E09.1.454.CMB.1.raw
  modified_base (164)..(165): a, c, t, g, unknown or other
  misc_feature (164)..(165): n is a, c, g, or t
tcagctcgcgtgtccacgaccggtgctcgatttagagagagtgtgttgggtttggggtgtggtggtctccactcccgccttgacggggctgctatctgcccctcggtcactctgttcccaccctcctcgacacgcgagctgagcgggctggcaaggcgcatagnn

SEQ ID NO: 283313 - DNA, 444 bp, Homo sapiens
  misc_feature: GYAE6OF02JJGVR.8.53.E09.1.454.CMB.1.raw
  modified_base (300)..(300): a, c, t, g, unknown or other
  misc_feature (300)..(300): n is a, c, g, or t
  modified_base (385)..(385): a, c, t, g, unknown or other
  misc_feature (385)..(385): n is a, c, g, or t
  modified_base (431)..(444): a, c, t, g, unknown or other
  misc_feature (431)..(444): n is a, c, g, or t
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacngcctgagttatttggctggttcggcggcgggactaagttcgaccgtctacgcagcccaaggctcgcccctgtcactctcgtcccncctcctcgacacgcgagctggagcgggctgggcaaggcgcagtcgnnnnnnnnnnnnnn

SEQ ID NO: 283314 - DNA, 587 bp, Homo sapiens
  misc_feature: GYAE6OF02ICXTL.8.53.E09.1.454.CMB.1.raw
  modified_base (270)..(270): a, c, t, g, unknown or other
  misc_feature (270)..(270): n is a, c, g, or t
  modified_base (342)..(342): a, c, t, g, unknown or other
  misc_feature (342)..(342): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcggggccccagggcaggagggtcctccatctcctgcacgtgggagcagaaccagcagtcgggcaggttangatgttcatcggtaccgcaggttccaggcacacgccccagacctcctcaataatgataacaacaatcgcctnacggggtctctgaccgattcctctcgccctccaagttccgtggcctacctttctcgtccttccccgtaggttcctaatacttccgttcgtccttcccgtggggttacgagggtatgggaggtccgtagtactttattaaccgtcgaccctactccctatgaacctacgacgtacctaggtacgtttaagtttcggtcttacgggtttcccgggccgggtaccgggtaacccgtaggttacccggg

SEQ ID NO: 283315 - DNA, 624 bp, Homo sapiens
  misc_feature: GYAE6OF02G5BFJ.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtggggccccagggcagagggtctccatctcctgcactgggagcagaaccagcagtcgggcgtaggtatgatgttctattggtaccgcctacggttccgaggcacacgccccagtacctcctctaattaatagaactaaacaactaaacgtcggaccctacgacggggtctcgtcgaccgtacttctctcgcctcctaagtctcggtctaccttcgtcgtcccttcccgtcggtacctacttacgttcgttcggttccttccgtaggggttcggaggtagtaggacggtcgtagttacgtttaacgttactcggaccctaccgttaccgtactacgtaactaaccgtaacgtcgtaggtaacggttagtttcggtacgttcgggttaccgggccgggtaccggggtaccgtaacggttaacccgg

SEQ ID NO: 283316 - DNA, 726 bp, Homo sapiens
  misc_feature: GYAE6OF02ITS28.8.53.E09.1.454.CMB.1.raw
tcagctcgcgtgtccacgaccggtgctcgatttagagagagtgtgttggggtttggggggctctgcttcagctgtgggcacaagaggcagcactcaggacaatctccagcatggctggtctcctctcctcctcactctcctcgctcactgcacagggtcctgggcccagtctgtactgacgcagcccgccctcagtactcgtcggggccccagggcaggagggtctccatctcctgcacgtgggagcagaaccagcagtcggggctaggttatgattgttctagttcggtaccgccgtacggttccaggccacgaccgcccccagacctcctactaattaatagaactaaacaacaacgtcccggcccgtacgtaacggggttccttcgtacggtaaccgtatttcctcgttccggcccttaccgtaagttccgtacgggctacctttcgtccgtccccttccgttcggtactacgttacgttccgttacggtcccttaccgggaggggttacgaagggttacgtacgggacggttacgttacgttaacgttttaccgttaccgttcgtaaccccttaacctttacccgttaacgttacgaaaccgtaaaccgtccggttaacccggttaggttaacggttttacggttttacgggtaccggttttcggggtttacccggggaccggggttacccgggttaacccggttaagggtttacccccggg

SEQ ID NO: 283317 - DNA, 447 bp, Homo sapiens
  misc_feature: GYAE6OF02F5XT7.8.53.E09.1.454.CMB.1.raw
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (438)..(447): a, c, t, g, unknown or other
  misc_feature (438)..(447): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcggcggcgggaccaagttcgaccgttcctacgtcacgcccaaggctcgccccctcggtccactctcgttcccnccctcctcgacncgcgagctgacggcggctgggcaaggcgcatagnnnnnnnnnn

SEQ ID NO: 283318 - DNA, 612 bp, Homo sapiens
  misc_feature: GYAE6OF02G5VTY.8.53.E09.1.454.CMB.1.raw
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
  modified_base (545)..(545): a, c, t, g, unknown or other
  misc_feature (545)..(545): n is a, c, g, or t
tcagctcgcgtgtccacgaccggtgctcgatttagagagagtgtgttgggtttggggggctctgcttcagctgtgggcaaaaagaggcagcactcaggacaatctccagcatggcctggtctcctctcctcctcactctcctcgctcactgcacagggtcctgggcccagtctgtactgacgcagcccgccctcagtatcgtcggggccccagggcaggagggtctccatcctcctgccacgtgggacgcaacgaaccagcgagtcggggctaggttatgattgttactagttcggtacccgtccgtacggttccgaggccacgaccgcccccaagtacccttcctactaattaactacgaactaaacaaactaacgtccggtccctacgacggggttcttacgtacggtaccgtacttcctaccgtccgtccctaccgtaagtccgtacggtacctacgttcctccgtcccttccgtcgtactactacgtcttggtcctcggnggtgaggtntgagtctgtattagttacncgtcctactctanacgacacgacgtccgtagtagtacgtttcgcgttcggttcgggcggacggtactacggtcgtacccg

SEQ ID NO: 283319 - DNA, 628 bp, Homo sapiens
  misc_feature: GYAE6OF02J2TLL.8.53.E09.1.454.CMB.1.raw
  modified_base (194)..(194): a, c, t, g, unknown or other
  misc_feature (194)..(194): n is a, c, g, or t
  modified_base (338)..(338): a, c, t, g, unknown or other
  misc_feature (338)..(338): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
tcagctcgcgtgtccacgaccggtgctcgatttagagagagtgtgttgggtttggggggcgtctgcttcagctgtgggcacaagaggcagcactcaggacaatctccagcatggcctggtctcctctcctcctcactctcctcgctcactgcacagggtcctgggcccagtctgtactgacgcacgccgccctnagtactcgtcggggccccagggccaggagggttcctccatcctcctgccacgtgggagcagaccagcagtcgggcaggttatgatgttcagttcggtaccgccgagttccacggcaccacgcccccagacctcctcaacttaanacgtaactaaacaacctaaacgtcccgggtccccttaggacggggttcctcgtacgtaacccgtactttcctcctaccgtcctaccctaacgttcgtcggacttaccgttcctcgtccctcccgttggtcctagtacttccgttggtcctccgtagggtgaggtactggacgtctagtattacgttacgcgtaccncttaccntacaccacgtacgtcctaggtaacgtttacgttcggtcgttccgggtacggtacccgggtacgggtaacccgtaggtttaaccccgg

SEQ ID NO: 283320 - DNA, 783 bp, Homo sapiens
  misc_feature: GYAE6OF02JSNTI.8.53.E09.1.454.CMB.1.raw
  modified_base (157)..(157): a, c, t, g, unknown or other
  misc_feature (157)..(157): n is a, c, g, or t
  modified_base (293)..(293): a, c, t, g, unknown or other
  misc_feature (293)..(293): n is a, c, g, or t
  modified_base (672)..(672): a, c, t, g, unknown or other
  misc_feature (672)..(672): n is a, c, g, or t
  modified_base (723)..(723): a, c, t, g, unknown or other
  misc_feature (723)..(723): n is a, c, g, or t
tcagctcgcgtgtccacgaccggtgctcgatttagagagagtgtgttgggtttggggggtcgtcgtgcttcagctgtgggcacaagaggcagcactcaggacaatctccagcatggcctggtctcctctcctcctcactctcctcgctcactgcacngggtcctgggcccagtctgtactgacgcagcccgccctcagtactcgtcgggggccccagggccaaggacgggtcctccgatcctccgtggcacgtggggacgcaagaaccaacgagtaccgggggcagggttacngtacgttgttcaatttcgggaacccgcgtacggttccacggaccaccgaccggtcccccaaaggtcccttcccgtactaacgtttaatcgtaaacttaaacaaccgtaacgttcccggaccccgttacggtaacgggggttccctacgtacggtaacccggttatttcccgtaccgtttccgcccgtttaaccccgtaaaggttccgtacgggtacccttaccgtttccgtccgtcccgttcccgttacggttacctacgttacgttcggttacggtttcccgtaccggtaggggttacgaggtacggtacgtacgggttcgttacggtttaacgtttaacgtttacccgttcggacccttaccgttaaccgtttaacncgaacccgtaacgtacggtccccgttagttaacggtttacgttaccgggtntttccggggttaacgggcccgggtaacccgggtaaccgtttacggttccggtaaccccgg

SEQ ID NO: 283321 - DNA, 543 bp, Homo sapiens
  misc_feature: GYAE6OF02GIRJX.8.53.E09.1.454.CMB.1.raw
tcagctcgcgtgtccacgaccggtgctcgatttagagagagtgtgttgggtttgggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggcccccagggcagagggtctccatctcctgcactgggagcagaaccagcatcggggcaggttatgatgttcattggtaccgccaggttccaggcacgagcccccagactcctcattaatgataacaaacaatcggccctcagggtctctgaccgattctctgcctcagtctgcacttctgcctcctggtcatactctgttctccgaggggtcaggatggaggctagtattaattactgaccctactacctatcgaaccaacgacggtcccttaggacgtttagttttacgggtcttacgggttccgggacggggcccgggtaaccgtaaggtttacccgg

SEQ ID NO: 283322 - DNA, 505 bp, Homo sapiens
  misc_feature: GYAE6OF02FMFRS.8.53.E09.1.454.CMB.1.raw
  modified_base (265)..(265): a, c, t, g, unknown or other
  misc_feature (265)..(265): n is a, c, g, or t
  modified_base (351)..(351): a, c, t, g, unknown or other
  misc_feature (351)..(351): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttangatgttcattggtaccgccaggttccaggcacagcccccagactcctcattaatgaataacaacaatcggccctcgaggggtctcngaccgattctctgcctccaagtctggcacttctgcctccctggtcattatctggtctccgagggtgaggatgaggtctgtattattactgccactcctatacgacaacgcgcctgagttattggcttggttcggcggcgggtacctagttccgg

SEQ ID NO: 283323 - DNA, 582 bp, Homo sapiens
  misc_feature: GYAE6OF02H8BYP.8.53.E09.1.454.CMB.1.raw
  modified_base (327)..(327): a, c, t, g, unknown or other
  misc_feature (327)..(327): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacaggtcctgggcccagtctgtactgacgcagcccgccctcagtatcgtcggggcccagggcaggagggtctcatctctgcacgtgggagcaagaaccagcagtcggggcaggttatgatgttacagttcggtaccgcctaggttccaggcacacgccccagactcctacattaangaataacaacaatccgcctgacgggtctcgtcgacctattctctcgtccctaccaagttccgtcggacctacttctcgtcctcccgtggtccattatccgtttgttcctccgtagggtgaggagttggagggtctagtaatttacgttacgtcgtacctaccttacctatacgaactaacgtacggtccttaggacgtttacgtttggtccgttcgggttccgggaccgggtaccgggtaccgtagttacccggg

SEQ ID NO: 283324 - DNA, 558 bp, Homo sapiens
  misc_feature: GYAE6OF02GE2NF.8.53.E09.1.454.CMB.1.raw
  modified_base (321)..(321): a, c, t, g, unknown or other
  misc_feature (321)..(321): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaangataacaacaatcgcctcagggtctctgaccattctctcgcctacaacgtctggctacttctcgccctcccgtggtccacttattctcggttcctccgagggtgagggtatggaggcttaggtatttacttacgtcgaccctacttcccgttaatcgaacaacgtacgaccttagtagttaacttttggccgttcgggttccgggccggggtacccgggtaccgtaaggttacccgg

SEQ ID NO: 283325 - DNA, 632 bp, Homo sapiens
  misc_feature: GYAE6OF02IUAKY.8.53.E09.1.454.CMB.1.raw
  modified_base (254)..(254): a, c, t, g, unknown or other
  misc_feature (254)..(254): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactccgtcggggcccccagggccaggacgggtcctccgatcctcctgcacgtggganaccacgaaccagcaagtcggggctaggttatgattgtactagttcggtaccgccgtacggttccgaggccacgaccgcccccagacctcctactaattaatcgtaataaaccgaactaacgtccggaccctcggagggttcctcgtcgaaccgtattccgtcctcgaccctacgtacgttcgtcggtcctaccttcgtcgtccctccgttcggtacctattacttcgttcgttaccgtcgtagggtgaggtagtcggacggtcgtagtacttacttacgtcaccctaccttacctataccgaactaaccgtcgtacctagtacgttagtttcggtacgttcgggttaccggaccggtacggtaccgtaggttacccgg

SEQ ID NO: 283326 - DNA, 732 bp, Homo sapiens
  misc_feature: GYAE6OF02JQMVW.8.53.E09.1.454.CMB.1.raw
  modified_base (236)..(236): a, c, t, g, unknown or other
  misc_feature (236)..(236): n is a, c, g, or t
  modified_base (660)..(660): a, c, t, g, unknown or other
  misc_feature (660)..(660): n is a, c, g, or t
  modified_base (671)..(671): a, c, t, g, unknown or other
  misc_feature (671)..(671): n is a, c, g, or t
tcagctcgcgtgtccacgaccggtgctcgatttagagagagtgtgttgggtttgggggtggtggtggtcgtccgatctcctgcactgggagcagaaccagcagtcgggcgaggttatgatgttcattggtaccgcgaggttccaggcacagccccagactcctcaattaactgataaacacaactccggcctcgagggtctctgaccgtattctctgcctcaagtctggcacttcngcctacccgtggtctatactcgtcgtctcccgtagggttcgaggtagtcggaagggtcgtaggtactttaagttaaccgtcgtaccccgtaaccgttcccttaagacggaacctaaaccgacggtcccttaggtaacggttttaacttcgggtcttcgggttcggggccgggtaccgggtaaccgtaaacggtttcggtacccggttaccgttacggtaccgacgtaccccgtaaaaggggcccttcggcccccccgttaggggtaccctaccccgttttaccgttacccggttaccccccgtacccccttacccggtttaccggaccccgtaaccccgggtccgttaaccgccgtttacggaccgggtccgggtaccgttcggccggtaaacccgcggtccgaagttaccggcgtcacgaccncgcgacgcgcncgcacgtcgacgcgcgcgtcgacgtcgtcacgtcgcgtacgacgtcgtacgtacgtagtcg

SEQ ID NO: 283327 - DNA, 636 bp, Homo sapiens
  misc_feature: GYAE6OF02JY6EK.8.53.E09.1.454.CMB.1.raw
  modified_base (499)..(499): a, c, t, g, unknown or other
  misc_feature (499)..(499): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtactcgtcggggccccagggcaggagggtctccatctcctgcacgtgggagcagaaccagcagtcggggctaggttatgattgttcagttcggtaccggaccgtacggttccgaggccaacgaccgcccccagacctcctctaattactgaataaacaacactccggaccctacggacgggtctacgtacgaccgtacttcctcgtacgtccttacgaacgtccgtgcctcttcgtcgtccttccctggtctacgttcgttcgttcggttcctaccgtagggtcgtacggtacgtgggacggttnttaggtaattttacgttacgtccgtacctaccttccttaagtacgtaacctacgtacgtaccgttaggtacgtttacgttggtccggtttacgggttccggggacccgggtaacgggtaccgttacggtttacccgg

SEQ ID NO: 283328 - DNA, 669 bp, Homo sapiens
  misc_feature: GYAE6OF02HODCS.8.53.E09.1.454.CMB.1.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtggggccccagggcaggagggtctccatctcctgcacgtgggancagaaccagcagtcggggcaggttangatgttcagttggtaccgccgtaggttccaggccacgacgcccccagacctccgtcaattaatacgaataaacaacaactaccggccctacgagggtctcgtacgaccgtattctctcgccctacgaagtcgtacggctaccgtttctcgtcccttcccgtggtacctacttagttccgttcggtccttaccggtagggtcggaagggttacgtcgggagggtaccgttaggtaacgttttaactttaccgtccggttaccctaaccgtttaccttaagtaccggaaacctaaaccgtacgttacccggttaggttaacgtttacggtttacgggttacggtttcgggttcccggggtacccggggtaacccgggttaccggtaaccgggttttacccggg

SEQ ID NO: 283329 - DNA, 488 bp, Homo sapiens
  misc_feature: GYAE6OF02I7WSO.8.53.E09.1.454.CMB.1.raw
  modified_base (301)..(301): a, c, t, g, unknown or other
  misc_feature (301)..(301): n is a, c, g, or t
  modified_base (453)..(454): a, c, t, g, unknown or other
  misc_feature (453)..(454): n is a, c, g, or t
  modified_base (460)..(460): a, c, t, g, unknown or other
  misc_feature (460)..(460): n is a, c, g, or t
  modified_base (465)..(488): a, c, t, g, unknown or other
  misc_feature (465)..(488): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccagggtgaggatgaggctgatttatactgccacgtcctatgacaacngcctggacgttatttggccttggttccggcggcgggaccaaggttcgacccgtcctacgtcagcccaaggctcgcccctggtcactctcgttcccacctcctcgacaccgcgagcctgacggccgggtctgggacaaggtcgcaatacgacnncgatcngtacnnnnnnnnnnnnnnnnnnnnnnnn

SEQ ID NO: 283330 - DNA, 778 bp, Homo sapiens
  misc_feature: GYAE6OF02IUBOK.8.53.E09.1.454.CMB.1.raw
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtcctccatcctcctgccacgtgggagcaagaaccagcacgtcggggctaggttatgagtgttactagttcggtaccgtccgtaggttccgaggtccaaccgaccgacccccaagacccttcctactaattaactacgaacttaaacaaccaacgtcccggacccgttacgtacggggttccttacgtacgtaccgtaactttcctacgttccgtacccttaccgtaaaggttcccgttacggtaccttaacctttcccgttacccggtccctttacccggttacgggtacccttaatttaccggttacccgttcgggttacccgttacggtacggggttaccggtaaggtacggtacgggtacggttaccgtttaggtaaccttttaacgttaccgttaccggtaccccttaaacgttacccttaacgtaccggaaacctaacccggtacggttacccgttagggttaaacgtttacggttttacggtacccggttttacgggttacccggggaccggggtaacccgggtaacccgttaacgggtttacccccggg

SEQ ID NO: 283331 - DNA, 569 bp, Homo sapiens
  misc_feature: GYAE6OF02IKU6T.8.53.E09.1.454.CMB.1.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (333)..(333): a, c, t, g, unknown or other
  misc_feature (333)..(333): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
tcagctcgcgtgtccacgaccggtgctcgatttagagagagtgtgttgggtttggggggctctgcttcagctgtgggcacaagaggcagcactcaggacaatctcagcatggcctggtctcctctcctcctcactctcctcgctcactgcacagggtcctgggcccagtctgtactgacgcacgccgccctnagtatcgtcggggccccagggcaggagggtcctccatcctcctgcacgtgggancagaaccagcagtcggggcaggttangtatgttcagttcggtaaccgcctaggttccagccacacgccccagacctcctacattaancgaataaacaactaaagtccggccctacgacgggtctcgtacgaccgtattcgtctcgcctaccaagtctggactcttctcgtccctccgtcgtctatacgttcgtgtctccggagggtgaggtatggacgtctagtattaatcgtacgacctactctacncgtaacacncgtacctagtaacgttacgttggtacgttcggttaccgggacgggtaccggtaccgttagtaccgg

SEQ ID NO: 283332 - DNA, 730 bp, Homo sapiens
  misc_feature: GYAE6OF02F9W0U.8.53.E09.1.454.CMB.1.raw
  modified_base (245)..(245): a, c, t, g, unknown or other
  misc_feature (245)..(245): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcacgccgccctcagtatcgtcggggccccagggcaggaggtcctccatctcctgccagtgggancagaaccagcagtcggggactaggttatgtatgttcagttcgggtacccgccgtagggtttcccgaggtcaaccgacgccccccagtaccctccgtactaattaacgtgaactaaacaaactaacgtccggaccctacgtacggggttctacgtacgtaacccgtatttcctaccgtcgtacccttacccgtaacgtccgttcgggccttaaccgtttccgtaccgttcccctccgttacggtacctacttaacgttccgtttacgggttcctacccggtaggggtcggtacggacggtttaggacgggttccgttaggttaacgttttaacgtttaacgttaccggtacccttaacgtttccccgttaacgttcgaaacctaaccgtacggtacccttaaggttaacggtttaagttttcgggtccggtttacgggttcccgggtaccggggtacccggtaaccgggttacggtttaccccggg

SEQ ID NO: 283333 - DNA, 477 bp, Homo sapiens
  misc_feature: GYAE6OF02JCZCU.8.53.E09.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (413)..(413): a, c, t, g, unknown or other
  misc_feature (413)..(413): n is a, c, g, or t
  modified_base (452)..(452): a, c, t, g, unknown or other
  misc_feature (452)..(452): n is a, c, g, or t
  modified_base (454)..(477): a, c, t, g, unknown or other
  misc_feature (454)..(477): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgccctccaagtctggcacttctgcctccctggtccatatcgtgtctccagggtgaggatgaggctgattatactgccactcctatgacanacgctgagtnttgcttggtcgggcggcgggactagttcgcccgtcctacgcagccccaaggcctcgccccctcgtccactctcgttccccaccctcctccgacaccggcgacncgtggacggccgggcgtcggacgacgggcgccagtagcngnnnnnnnnnnnnnnnnnnnnnnnn

SEQ ID NO: 283334 - DNA, 168 bp, Homo sapiens
  misc_feature: GYAE6OF02F2J97.8.53.E09.1.454.CMB.1.raw
  modified_base (166)..(168): a, c, t, g, unknown or other
  misc_feature (166)..(168): n is a, c, g, or t
tcagctcgcgtgtccacgaccggtgctcgatttagagagagtgtgttgggtttgggggtgtggtggtctccactcccgccttgacggggctgctatctgccccctcggtcactctgttcccgccctcctcgacacgcgagctgagcgggctggcaaggcgcatagnnn

SEQ ID NO: 283335 - DNA, 680 bp, Homo sapiens
  misc_feature: GYAE6OF02IOVL8.8.53.E09.1.454.CMB.1.raw
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacaggtcctgggcccagtctgtactgacgcagcccgccctcagtatcgtcgggccccagggcaggagggtctccatctcctgcacgtgggagcaagaaccagccagtcggggctaggttatgatgttcagttcggtaccgccgtaggttccgacggccaacgacgacccccaacgtacctcctactacttaaatacgtaactaaaccaaacgaaacgtccggaccccgtacgtacggggtccttccgtcggtaacccgtactttcctaccgttcgaccccgttaccgtaacggttccgttacggccgtactttcctacgttccctcccgttcggtacctattacgttcgttcggttcccttaccggtaggggttacgacgggtagtcggtaacggtcgttaggttaacttttaacgttaccgtcggtaccctaaccgtaccctagtaccgaacctaacgtaccgtcctaggttagttacgtttacggtcgttcgggttccgggcgggtaccggtaccgtaagttacccgg

SEQ ID NO: 283336 - DNA, 649 bp, Homo sapiens
  misc_feature: GYAE6OF02G6WLC.8.53.E09.1.454.CMB.1.raw
  modified_base (530)..(530): a, c, t, g, unknown or other
  misc_feature (530)..(530): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacgagggtcctgggcccagtctgtactgacgcacgccgccctcagtatcgtcggggccccagggcaggacgggtcctccatcctcctgccacgtgggagcagaaccgagcgacgtcggggactaggttatgtagttgttactacgttcggtaccgccgtacggttccgacggcctacgaccgccccgacgactcctactaattaactagaactaaaccaactaactccggacccgtacgtacggggttacctcgtacgaccgtacttcgtcgttacgcccgtaccgtaacgttccgtacggtaccttaccgttcgtaccgtcccgttcccgttaggtacctacgttacttcgttacgttcgtaccggtagggtcgacggngttaggacggtctagtacgttagttcctcgtacctactcgtacgtagacacgtcgacttggtaacttgtttacggtcgttacggttccggaccgggtaccggtaccggtagttacccgg

SEQ ID NO: 283337 - DNA, 654 bp, Homo sapiens
  misc_feature: GYAE6OF02G6QYI.8.53.E09.1.454.CMB.1.raw
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcacgcccgccctcagtactcgtcggggccccagggcaggacggtctccatcctcctgcacgtgggacncagaaccagcaggtcgggcaggttangattgtctagttcggtaccnccgtaggttccaggcacaccgccccaagcctctacattaangactaaacaataagttcggacctggtacgggtctcgtacgaaccgttattctcgtccgtcctacctaacggtcttacggtacctacctttcgtaccgtcccgttcccgtcggttacctacttactccgttcggttcctacggggtaaggtcggtaagtcggtagggtacggtcttagttaactttacgttacgtcgtacctaaccttaccgttataccgaaccgtaaccgtcggttaccgtaggttaacgtttacggtttcggtccgtttacggggtttaccgggccggggttaaccggtacgtacggtttaccccggg

SEQ ID NO: 283338 - DNA, 748 bp, Homo sapiens
  misc_feature: GYAE6OF02FR8UL.8.53.E09.1.454.CMB.1.raw
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
  modified_base (335)..(335): a, c, t, g, unknown or other
  misc_feature (335)..(335): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatccgtcggggccccagggcaggacgggtctccatcctcctgcacgtgggancagaaccagcagtcgggcaggttangattgttctagttcgggtaccgcgacggttccgaggaccacacgcccccagtacctccctanaattaatcgaataacgaaacaacgtccggaccctacgtaggggtcctcgtacgaacccgtatttcctcgtcgtacccctacaacgttcgtacggtcctacctttcgtaccgtccccgttccccgtacggtacctactttaacgttccgtcggttacccgttaccggtacggggtaggaacgggttaacggtcgggtaacgggtccgtttaggttaaacgtttttaacgtttaaccgttccgaaccccttaacccgtttacccgttaagttaccgaaaccggtaaaccgtccggtaccctttaagggtaaccggttttaacgggttttgggttaccggttttcccggggtttaacccggggacccgggggttaaccccggggtaacccgtttaaccggggttttaacccccggg

SEQ ID NO: 283339 - DNA, 798 bp, Homo sapiens
  misc_feature: GYAE6OF02FWT3F.8.53.E09.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagagagtgtgttgggtttggggggctctgcttcagctgtgggcacaagaggcagcactcaggacaatctccagcatggcctgttctcctctcctcctcactctcctcgctcactgcacagggtcctcgggcccagtctgtactgacgcacgccgccctnagtactcgtcggggccccagggcaggacgggtcctccactcctcctgcgacgtgggacgacacgaaccacgacgacgtcgggtacgtacggttagtagtagtgttacgtacgttacggtaccgtccgtacggttaccgacggaccgaccgaccgaccccgacgtacctacctactaacttaacgtacgtaactaaacaaactaacgtaccggtaccgtacggtacgggttaccgtcgtaaaaaaaaacgtccgtacgttccgttcgttaccgtacccgtaccgtaacgttccgtacggtaccgttaccgtttccgttccgttccccgttcccgttacggtaccttaacgtttacgttaccggttccggtttacccgtacccgggtaacggggttacgggtaacgggttaacggtacgggtaacgggttcgttaacgtttaacgtttaacgtttaccgttaccgtacccttaacccgttaccgttaacgttaccgtaaccgtaaccgtaacggtaccgttaacggttaacgtttacggtttacggttaccggttacgggttaccggggtacccgggtacccgggtacccggtaccggttacccgg

SEQ ID NO: 283340 - DNA, 553 bp, Homo sapiens
  misc_feature: GYAE6OF02I3Z9P.8.53.E09.1.454.CMB.1.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (384)..(384): a, c, t, g, unknown or other
  misc_feature (384)..(384): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggaggtcctccatctcctgcacgtgggancagaaccngcagtcgggcaggttangatgttcagttggtaccgcaggttccaggtcacacgccccagactcctnaacttaangaataaacaactaagtccgacctagacggggtctcgtacgacgtattctctcgcctacaagtcngctacttctcgccctccgtggtctatactcgtgtctcgtaggtcgagatggagtctgtaactttacgtactcggacctcgtactagtacgacctaacgcgtccgtagtagtttaacttcggtacgttcgttacggcggtaccggactaaggttcgtaccgtcgtaaccg

SEQ ID NO: 283341 - DNA, 521 bp, Homo sapiens
  misc_feature: GYAE6OF02FTQO5.8.53.E09.1.454.CMB.1.raw
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagctcgcgtgtccacgaccggtgctcgatttagagagagtgtgttgggtttggggggctctgcttcagctgtgggcacaagatgcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcagtcggggcaggttatgatgttcattcggtaccgccaggttccaggcacacgcccccagacctcctcattaatgaataacaacaactccggtccctacgaggggtctctagaccgtattctctcgcctaccaagtctggcacttctcgcctccgtgtcattactctgtcctcaggtgagntagngctgtattattactntccactctatacgacaacagtcctagtacgttatttggcgtttggtccgggcggtacgggtacccgtaacgg

SEQ ID NO: 283342 - DNA, 720 bp, Homo sapiens
  misc_feature: GYAE6OF02H1V4R.8.53.E09.1.454.CMB.1.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggacgggtcctaccatcctcctgcacgtgggancaagaaccagcagtcggggcaggttangattgttngttacggtaccacgtaggttcaggcacncgcccagcctctanatatgactaacaacagtccgtccctgacgggtctcgtacgaccgtattccgtactcgcccttacgaacgtccgttcggacttaccgtttcgtcccgtacccttcccgttaggtaccttaagttacgttccgtttccggtaccttacgggtaagggtacgtaacgggtacgtacggtaacgggttccgttagttaaactttacgttaccgtaccgtacccgttaaccctttcgttaacgtaacgtaacccgtaacgtacccggttacggtttacgggttaacgttttaccggttttaccgggtacccggttttccgggttacccggggacccggggttacccgggtaaacccgtttacccgggttttaacggtaccccccgggttttagtaaccccccgggg

SEQ ID NO: 283343 - DNA, 709 bp, Homo sapiens
  misc_feature: GYAE6OF02IW2QQ.8.53.E09.1.454.CMB.1.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (632)..(632): a, c, t, g, unknown or other
  misc_feature (632)..(632): n is a, c, g, or t
  modified_base (685)..(685): a, c, t, g, unknown or other
  misc_feature (685)..(685): n is a, c, g, or t
tcagctcgcgtgtccacgaccggtgctcgatttagagagagtgtgttgggtttgggggtggtggtggtctcatctcctgcactgggagcagaaccagcatcggggcgaggttatgatgttcagttggtaccgcgtaggttccaggcacacgcccccagacctcctcaattaactgaataacaacaatccggccctagaggggtctctgaccgattctctcgcctaccgaagtccgtggcctactttcncgtccctccctggtaccatactcgtggtccttccgaggggttnacgggatcggaggctagtattattacncgacctaccgttacttagacgaacctaaaaccgnggtccttaggtacgtttaagtttcgggacctttggttaccggggcggtacgggtacctaagttccggaccgtcctaacggtcgacgccccgaaaggtcctccggtaccccccgttaggacccaacgttccctttaacccgggtcccctaacccccgttcccgtacgtaaccgaacccggtcgtaccggtccttaggggaacccggttacccggggcgttcggggaaccccgaaagggttcccgggacctaagggtttaacgcgaacgcggtactacgtcncgtacgtacgtacgtacgacgacgacgacgacgtcgtacgtactctcgtacgngacgtcgactacgcgtacgtcgtc

SEQ ID NO: 283344 - DNA, 587 bp, Homo sapiens
  misc_feature: GYAE6OF02GT8AE.8.53.E09.1.454.CMB.1.raw
  modified_base (336)..(336): a, c, t, g, unknown or other
  misc_feature (336)..(336): n is a, c, g, or t
tcagctcgcgtgtccacgaccggtgctcgatttagagagagtgtgttgggtttgggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtctccatctcctgcacgtgggagcagaaccagcagtcggggctaggttatgatgttcagttggtaccgcctacgggttccaggcacaccggcccccagacctcctactattaangaactaaacaacaactcggtacccctacggtacgggttctcctagaaccgtattctctcgcctccaagttctggcctacttcgtaccgtccctacccgtggtacattacgttcgtcggtcctcggagggtcgaggtgtgaggtctattaagttattccgcgtaccctacgttctatacgacaacgtacggccttaggaagtttgttcggtcgttcgggttccgggcgggtaccggtacgtaacgttcccgg

SEQ ID NO: 283345 - DNA, 618 bp, Homo sapiens
  misc_feature: GYAE6OF02JXVGU.8.53.E09.1.454.CMB.1.raw
  modified_base (273)..(273): a, c, t, g, unknown or other
  misc_feature (273)..(273): n is a, c, g, or t
  modified_base (325)..(326): a, c, t, g, unknown or other
  misc_feature (325)..(326): n is a, c, g, or t
  modified_base (328)..(328): a, c, t, g, unknown or other
  misc_feature (328)..(328): n is a, c, g, or t
tcagctcgcgtgtccacgaccggtgctcgatttagagagagtgtgttgggtttgggggcgtctgcttcagctgtgggcacaagaggcagcactcaggacaatctccagcatggcctggtctcctctcctcctcactctcctcgctcactgcacgagggtcctgggcccagtctgtactgacgcagcccgccctcagtatcgtcggggccccagggcaggacgggtctccatcctcctagcacgtggagcagaaccagcagtcgggcaggttangatgtcagttcggtaccgcacggttccaggcacacgccccagctcctcatannanaacaacaatcgacctgacgggtctctacgacgtacttacgtctcgtccctaccgaacgtcgtcggactaccttcgtccgtcccttccgtcggttactacttacgttcgttacggtcctccggtaagggtcggagggtctagggacggtcgttaaggtactttacgttaaccgtcgtacccaaccgttaccttagtaccgtaaccgtaacgtacgtaccgttagtacggtttaactttcggacgttttcgggttaccgggccgggtaccggggtaacctaaggttacccgg

SEQ ID NO: 283346 - DNA, 656 bp, Homo sapiens
  misc_feature: GYAE6OF02F10X9.8.53.E09.1.454.CMB.1.raw
  modified_base (251)..(251): a, c, t, g, unknown or other
  misc_feature (251)..(251): n is a, c, g, or t
  modified_base (544)..(544): a, c, t, g, unknown or other
  misc_feature (544)..(544): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacgcacgccgcctcagtatccgtcggggccccagggcaggacgggtctccattcctcctgccacgtgggacncaacggaaccagtacaggtccgggggactaagggttatacgtagttcgtttactaggtttaccgggtaccgccgtaacgggttccaacggccaccgaccgccccctaaggaccttcccgttactaatttaagacgaaacttaaaccgaaacaacgttcccggacccttagggacgggttcctacggtccgaaccttacttcctcttcgaccttaccacgtcgtacggcctacgtttcctcgtcccttcgtcgtactacttacgttcgtacgtaccgttcggaggtagagggtntggagtctagttacttacgtctcactcgtactactacgaactacgtacgccgttagtcgttaggtttcgtcggttccggtacgggcgggtaccggtacgtaccggttaccgg

SEQ ID NO: 283347 - DNA, 802 bp, Homo sapiens
  misc_feature: GYAE6OF02JOF7P.8.53.E09.1.454.CMB.1.raw
  modified_base (156)..(156): a, c, t, g, unknown or other
  misc_feature (156)..(156): n is a, c, g, or t
  modified_base (307)..(307): a, c, t, g, unknown or other
  misc_feature (307)..(307): n is a, c, g, or t
tcagctcgcgtgtccacgaccggtgctcgatttagagagagtgtgttgggtttgggggtcgtcgtgcttcagctgtgggcacaagaggcagcactcaggacaatctccagcatggcctggtctcctctcctcctcactctcctcgctcactgcacngggtcctgggcccagtctgtactgacgcacgccgccctcagtactcgtcggggccccagggccaggtacgggtcctcccgatccgttacccgtgccgtacgtggggacgcaacggtaaccaggcacgtccgggggcctaagggttttaacnggtacttggttactacgtttcggtacccgccgttaacggttccaggtccaaccgtcggccccctaagtcctccctacctaagtttaacctagaactaaaccaactaacgttccggacccttcggaacgggttcctccgtacggtaccctagtttcctaccgtcgtacccctaccgtaacgtccgtacggttacctaccgtttacctccgtcccgtttacccgttacggtccccttaatttaaccggtttccgtttaccgggttccgttacccgggtaagggttacggtaacgggttacgttagggtaccgggtactttacgggttaaactttaaggttttacccgtcggtaacccctaaccggttaccttaacggtacgtaaaccgtaacgtccggtacctttacgggtaaacggtttttgtttaccgggttcgtttacccgggttccggggtacccggggttacggttaaccccgttaacgggtttaccccggg

SEQ ID NO: 283348 - DNA, 772 bp, Homo sapiens
  misc_feature: GYAE6OF02HC8ZM.8.53.E09.1.454.CMB.1.raw
  modified_base (285)..(285): a, c, t, g, unknown or other
  misc_feature (285)..(285): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacgagggtcctgggcccagtctgtactgacgcacgcccgccctcagtactcgtcggggccccgagggcaggacgggtcctccatcctcctgcacgtgggacgcaacgaaccagcaggtcggggactaggttangtagttcgttctacggttcgggtacccgccgtacgggttccgaggaccaccgaccgaccccgaagtaccctcctactaattaacgtacgaaactaaacaacgtaaccgtcccgggacccgttacggtacggggttcctaccggtacgtaaccgttactttccgtaccgttccgtaccctaccgtaacgttccgtacggtaccttaccgtttccgtccggttcccttcccggttacggtacctaacgtttcgttaccggtttcggttacccgtacgggtaggggtacggtagggtacgtcgggtacggttcgttaacggtttaactttaacgttaccgttccgtacccttaaccgttaccttacgtacgtaacctaacggtacgttaccggttaacgggttaacggttttacggttcgggttaccggtttaccggggttacccggggtacccggggtaccgggttaaccgttaccggggttaccccgg

SEQ ID NO: 283349 - DNA, 874 bp, Homo sapiens
  misc_feature: GYAE6OF02J0J6M.8.53.E09.1.454.CMB.1.raw
  modified_base (290)..(290): a, c, t, g, unknown or other
  misc_feature (290)..(290): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacgtagggtcctgggcccagtctgtactgacgcacgccgccctacgagttacgtccggtcggggcccccgagggccgaaggtacggggttcctcccgtattccgtccttacggcacgttggggacgccgaacgaaaccgngacgtacggtcggggacgtaggtttaacttaggtacgttggttaccttaggttaccgggtacccggtaccgtacggtttaccgacggtacgtaaccccgaaccggtccccccgaacggttaccccttaccgttaccgttaaacttttaaataccgttaaaaactaacccgaaaaacgtaacccgggtttccccggtaccccggttacgggtaccgggggtttaccctttcggttaaccgggtaaccccggtttaacttttcccgttcgtaaccgggttccccttaccgttacggtaccggtcgtaccgtttaccgtttccgttccgttaccccgttaccgttccggttaccttacgttaaccgttccggtttccgggttaccgtacccgggtagggtacggtaagggtacggttcggtacggttcgtaagttaacttactttaccgtaccgtaccctaacgttccgttaaccgtacgtaaccgtacccgtacggtaccgttacggtaacgttttacggttcggttccggttccgggttacccgggtccggggtaacccggttaccggttaacgttaaccccggg

SEQ ID NO: 283350 - DNA, 730 bp, Homo sapiens
  misc_feature: GYAE6OF02GXDEW.8.53.E09.1.454.CMB.1.raw
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (578)..(578): a, c, t, g, unknown or other
  misc_feature (578)..(578): n is a, c, g, or t
tcagctcgcgtgtccacgaccggtgctcgatttagagagagtgtggttggggtttggggggctctgcttcagctgtgggcacaagaggcagcactcaggacaatctccagcatggcctggtctcctctcctcctcactctcctcgctcactgcacgagggtcctgggcccagtctgtactgacgcacgcccgccctcgagtactcgtcggggccccagggcaggacggtcctccactctcctgcctacgtgggacacaacgaaccngacgagtcggggactaggttancgtagtgttactacgttcggtacccgcgtaacggttcccgaggccaaccgaccgacccccgaagtaccctacctacgtaagtttaaacacgtaaactaaaccaacgtaacgttccccgggaccctacgggtacgggttaccttaccgtaccggaaccgtactttcccgtacgtcccgtacccttaaccgtacgttaccgtcggtacttaccgtttccgtcccgttacccttccgttacggtcctaacgttacgttcgttcggttaccgtaccgggtagggtagtaacggngttacggaggttccgttaagttagttacttacgtacgacccttacgttaccgtagtaccgaactaaccgtccggtaacgttacggttacgttacgtttcggttacggttacgggttccgggaccgggtaccggtaccggtacgttacccggg

SEQ ID NO: 283351 - DNA, 643 bp, Homo sapiens
  misc_feature: GYAE6OF02ITQXV.8.53.E09.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgagggtcctgggcccagtctgtactgacgcagcccgccctnagtatccgtcggggccccagggcaggtagggtcctccatcctcctgcgacgtgggancgaagaaccagtcgagtcggggactaggttagtcgatgttactacgttcggtaccgcctacggttccgaggccaacgaccgaccccaaagccttacctataattanagtaactaaaacaacaacgtcccggtccgtagtacgggtctcgtacgaccgtattcctcgtcgcctacgaacgttctacggtctacctttcgtacgtcccgttccgtggttcctaattccgttcgttccggttccgtaccggtaggggtgacggtcgtaggtacggtctttagtatttacgttacgtcctacctaccgttcttaagtacgtaaccaacgtctcggttagtaagtttccgttaggtccgttgggtacccggtggggacccgttacgacgttaaccgg

SEQ ID NO: 283352 - DNA, 804 bp, Homo sapiens
  misc_feature: GYAE6OF02GG20H.8.53.E09.1.454.CMB.1.raw
  modified_base (643)..(643): a, c, t, g, unknown or other
  misc_feature (643)..(643): n is a, c, g, or t
  modified_base (718)..(718): a, c, t, g, unknown or other
  misc_feature (718)..(718): n is a, c, g, or t
  modified_base (756)..(756): a, c, t, g, unknown or other
  misc_feature (756)..(756): n is a, c, g, or t
tcagctcgcgtgtccacgaccggtgctcgatttagagagagtgtgttgggtttgggggtgtggtggtctcctatctcctgctaacgtgggtacgcagtaaccagtcatcggggcagggttatgatggttcattggtaccgccaggttccggaggtcacacgcccccagacttcctcagttaactgataacacaacttcggccctgacggggttctctgacccgtattcctcgtcgccctaccgtaagttcctgggacctacctttcgtacggtccccttacccttggtacctacttattccggtcggttccttcccggaggggttacgacggtacttacggtaacggtccgttggtaactttacgttaaccgtcggtaccccttaacccgttacccttaacgtaccggaaaaccgtaaacgaccggttaccccgtacggtaaacggtttaaacgttttcggggccttttcggggttcccgggtccggggtacccggggtaaaccccttaaaaggggtttacccgtaacccgttcccgtaacggttccgaaaccggtaccccgaaagggttcctaccccggtcccccgttggttaaccctacgttcccgtttccgtaccccgacccgttacccgtaccgaaccnccgaccggtaccgcgtacgggaccgtccggtacgtacggtaccgtaacggcgtaccgtacggtaggactagtcgnacgtccgataccgcgtcgcgacaccggtacgccgtacncgtcgtacctaccgtacgtctactctacgacgtcgtcgtcgtacgtcg

SEQ ID NO: 283353 - DNA, 509 bp, Homo sapiens
  misc_feature: GYAE6OF02F28O3.8.53.E09.1.454.CMB.1.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (475)..(476): a, c, t, g, unknown or other
  misc_feature (475)..(476): n is a, c, g, or t
  modified_base (479)..(480): a, c, t, g, unknown or other
  misc_feature (479)..(480): n is a, c, g, or t
  modified_base (482)..(483): a, c, t, g, unknown or other
  misc_feature (482)..(483): n is a, c, g, or t
  modified_base (486)..(486): a, c, t, g, unknown or other
  misc_feature (486)..(486): n is a, c, g, or t
  modified_base (488)..(491): a, c, t, g, unknown or other
  misc_feature (488)..(491): n is a, c, g, or t
  modified_base (493)..(509): a, c, t, g, unknown or other
  misc_feature (493)..(509): n is a, c, g, or t
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctcctgtcatatctggtctccgagggtgaggatggaggtctgatttattactgccctactcctatcgaacaacagcctgagttagtttggcttggttcggcgggacggacctaaggttcgacccgttctacgtcacgcccaaggctccgcccctcggtccactcctcgtccctccctcctcgaccncgcgagtctaggnggccggggctcgggaccgaagggtcccgacgtaacgtacggnngcnngnngcngnnnncnnnnnnnnnnnnnnnnn

SEQ ID NO: 283354 - DNA, 645 bp, Homo sapiens
  misc_feature: GYAE6OF02F40Z3.8.53.E09.1.454.CMB.1.raw
  modified_base (392)..(392): a, c, t, g, unknown or other
  misc_feature (392)..(392): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacgagggtcctgggcccagtctgtactgacgcagcccgccctcagtatcgtcggggccccagggcaggacgggtcctccattcctcctgcctacgtgggacgcgaacgaaccagcaggtcggggctaggttataggagttcggtttacagtttcgggtaacccgtccgtaacgggtttcccgaaggggccaaccgacccggaccccccgtaacggtaacccttcccgttaacctaaagttttaaacnggtaaaactaaaaccgtaaaacaacggtcccggtaccctaggtacggggtcctcgtacgaacgttacttcctcgtcgtaccctacgaacgtcgtcggccttacgtctcgtcctccgtgctatactcgtcgtctcgnggtcgagntgcgtgtgtattactactcgacctacgttactagactaacgctacgtcgtagtacggttagttcgtcgtcggtacggccggacgtacggtacgtcgtaccgtactacgg

SEQ ID NO: 283355 - DNA, 662 bp, Homo sapiens
  misc_feature: GYAE6OF02HUNLX.8.53.E09.1.454.CMB.1.raw
  modified_base (245)..(245): a, c, t, g, unknown or other
  misc_feature (245)..(245): n is a, c, g, or t
tcagctcgcgtgtccacgaccggtgctcgatttagagagagtgtgttgggtttggggggctctgcttcagctggtgggcacaagaggcagcactcaggacaatctccagcatggcctggtctcctctcctcctcactctcctcgctcactgcacagggtcctcgggcccagtctgtactgacgcagccgaccctcagtatcgtacggggcccagggcagaggtctccatctcctgcacgtggganacaacgaaccagacacggtcggggactaggttaatgtattgttactagttacggtaccgcgtacggttcgacggcacgaccgaccccagtacctctacgtattaactagaaataaacaacgaacgtccggcctacggtagggttcctacgtacgaccgtacttaccgtctaccgaccctacgtaacgtctcggaccttaccttccgtccgtcccgttaccgtcgtactacgttacgttcgtaccggttctaccggtaggggtacgacgggtagtcggagtcgtattacgttacttaccgtcgtacctaccgttacgtactacgtaacgaaccgtcggtaacctaggttaacgtttacgtttggtacggttcgggtaaccggggtccgggtaaccggtaccgtacggtttaacccggg

SEQ ID NO: 283356 - DNA, 582 bp, Homo sapiens
  misc_feature: GYAE6OF02HSKBD.8.53.E09.1.454.CMB.1.raw
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
  modified_base (272)..(272): a, c, t, g, unknown or other
  misc_feature (272)..(272): n is a, c, g, or t
  modified_base (326)..(326): a, c, t, g, unknown or other
  misc_feature (326)..(326): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacncagccgcccctnagtatctcggggccccagggcaggagggtcctccactcttcctgcactgggagcagaaccagcagtcgggctaggtangatgttcattcggaccgctaggttccaggcacacgccccagcctctcattaacngataacgaacacgtccgccctagacgggttctacgtggacctattctactcggacctacgaagtccgtggacctacttcctcgtccttcccggtgtcctagttactcgttcgtccgttcggagggtggacgggtattggacggtctagtacttacttactcgcctaacgttcccttagtacgaacctagccgtccttaggtacgttacgtttcggtacgttcggttacgggccggtacggtaccgtaggttacccg

SEQ ID NO: 283357 - DNA, 735 bp, Homo sapiens
  misc_feature: GYAE6OF02GBXVV.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctctctcctcctcactctcctcgctcactgcacagggtcctgggcccagtctgtactgacgcacgccgcctcagtatcgtcgggcccaggcagaggtctccatctcctgctacgtgggacgcaacgaaccagcagtcgggactaggttatgtatgttcgattcggtaccgccgtacgttccgaggtcacgacgtcccccagtactacctcgtacttaatacgtaactaaacctaaactaacgtttacggccccttacggacgggggttacttacgtacgtacccgtattttacctcgtcgtacccttacgaacgttcgtcggacctaccgtttaccgtccgtaccccttccgttcggttacctaacgtttacgttaccgttcggtttacccgttccggaagggggttacgtaacgggttacgtagggttacggtacgtttacggttaacttttaacgttaacccgttccggtaccccttaacgttacccgttaagtacccgttaaccgaaacggttaccgtacccttagggtaacgtttacgttttacggtaccggttttacgggttacccgggtccggggtaacccgggttaaccgtaaccgggtttaccccggg

SEQ ID NO: 283358 - DNA, 675 bp, Homo sapiens
  misc_feature: GYAE6OF02GQGBB.8.53.E09.1.454.CMB.1.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (552)..(552): a, c, t, g, unknown or other
  misc_feature (552)..(552): n is a, c, g, or t
  modified_base (617)..(617): a, c, t, g, unknown or other
  misc_feature (617)..(617): n is a, c, g, or t
tcagctcgcgtgtccacgaccggtgctcgatttagagagagtgtgttgggtttggggggctctgcttcagctgtgggcacaagaggcagcactcaggacaatctccagcatggctggtctcctctcctcctcactctcctcgctcactgcacacgggtcctcgggcccagtctgtactgacgcacgtcccgccctcgagtactcgtcggggccccagggccaggagggtcctcatccgtcctgcgacgtgggganccaaggacccagctaggtcggggataggttangtagttcgttctaagttcggtaccgaccgtacgggtaccacgggccaaccgaccggtaccccctaagtacctacccgttactaactttagtaacaaacgtaaacaaccgtaaccgtccggccctacgggtaccgggttccttacgtaccgggtaccttacgtttccgaccgtcggttacccctacgtaacgttcgcggtccttacctcgtccgtccccgtacgtcgtactattcgtcgtcggttacctcgggtagggttgacggngtacggcggtacttggttaactttacgtactccgccttaacttcctagtactcgaacgtccggtntaagggtcctttagtccggtcgttccgggtacgggacggtacggtacgtagttcccgg

SEQ ID NO: 283359 - DNA, 737 bp, Homo sapiens
  misc_feature: GYAE6OF02JWU1Y.8.53.E09.1.454.CMB.1.raw
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtacctggacncacgccgccctanagtatccgtcggggcccctagggcctaggcgggttcctaccagttcctcgtgctaaccgtggggacacgaacgaaccgacgactacgacggggtcctaaggtttagtcggtaatttggttacgtacgtttacggggtaacccggccggttaacggttccggaaggcccacgaccgtcccccgataaccgtcccttacgtagttaaacgtcgaactaaacaactacggtaccgtccgtacgtacgggtctacggacgtaccgtactttcgaccgttacgtccccgtaaccgtaacgttccggtacggtaccttacccgttccgttaccgcccgtttcccgtacggttccctaattcgtttacggtccgttacgttcccggagggtacggtaaggtcggtacgacggtctaacggttactttacggttaacgtctcccgtaacgttaccgtacgtacgtaacgtaccgcgttacgttaccggtagtttacgtttccggtcgttacggttccccgggagggtccggtaccgtaaggttacccgg

SEQ ID NO: 283360 - DNA, 804 bp, Homo sapiens
  misc_feature: GYAE6OF02HX0IK.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtcctctctcctcctcactcctcctcgcctcactcgccacggacgggtccgtccgggcccagttctcgtacgtcgacgcaccggcccctccctacaggttactccggtccggggaccccgagggaccgagggtacggttccctaccgtactccctccgtcggcgtacggtcggggaacgtacgaaccgaaccgaaggcgacgggtaccggggacgtaacggttacgtagtttcgttacgttacggttaccgggtaccccgtaccggtaccggttccgaaccggtaccgaacccgaccccgtaccccgtaacgtacccttaccgtacttaagttaacgtaacgtaaactaaaccgaaacgtaccgtccggtacccttcgggtacggtcttacgtacgtaccgttacttccgtcgttacccgtacccgtacgtacgttccggtccgtaccttaccgtttccgtcccgttcccgttaccgttcgtacttacgttaccgttccgttacgggttcccgtacgggtagggtacggaggtacggtcggtacgttaccgttaagttaccgttaacgttcccgacgtcccttaacgtacgttaaccgtacgaaccgtaccgtacgtccgtagttaccgtttgtaccggttcggtcggtcgggtaaccggtaccggtaacgtcggttacgtacccgg

SEQ ID NO: 283361 - DNA, 767 bp, Homo sapiens
  misc_feature: GYAE6OF02FR8MP.8.53.E09.1.454.CMB.1.raw
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagcccgccctcagtatccgtcgggggccccagggcaggacgggtcctccattcctcctgcacgtgggacgcaagaaccagcacgtcggggctaggttatgattgttctaagttcggtaacccgcctaacgggtttccgaggcaacgaccgcccccgaagtacctcctacaacttaatgaaactaaacaacaacgtccggaccctcgacggggtcctcgtacgaccgtacttcctacgtcgaccttaccgtaacgtcgtacggtacctactttccgtccgtccccttacccgttcggtacctaacgttacgttccgttacggttccgttacggtaggggttacggtaacgggtagttacgggtacgggtccgttaaggttaactttaacgtttaaccgtaccggtacccttaacccgttacccgttaaacgttaccgtaaaccgaaaccgttaccggtaccgttaagggttaacggttttaacggtttcgggttaccggtttaccggggtttaccggggacccggggttaaccgggggttaaacccttaacggggtttacccggttacccccggttaccggttaaccccggg

SEQ ID NO: 283362 - DNA, 822 bp, Homo sapiens
  misc_feature: GYAE6OF02FY0D2.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagcccgccctcagttatcgtggggccccagggcaggagggtctccattcctccgtgaccacgtgggagcgaacgaacccagtccgaagtccggggactagggttactagtaattggttcaagtttgggtacccgccgtaagggtttcccgaagggtccaccgtacgaccccccgtagtaacccttcccgttacgtaatttaaacgtcggtaaacttaaaccgaaacctaaaggtccccggtaccccttacggtaacgggggttccttacggtacggtaacccgtaactttcccgttacgtccggtacccgtcccgtaaacgtttcccgaggggtaccctaaccgttttacccggtacggtccccgtttacccggttacgggttaaccctaacttaacggttcccgttacgggttaccccggttaccgtaagggggttacggtagggtaacggttacgggacgggttaccgttagggtaacttttaacgttaccgtaccggtaaccctaaccgttccgtaacggttacgaacctaaaccggtaacggtacccgttagggttaacgtttacggttttaccgggcgtttccgggtaccggggtacccggggtacgggtttaacccgaaggttttaccccgggg

SEQ ID NO: 283363 - DNA, 673 bp, Homo sapiens
  misc_feature: GYAE6OF02HDC49.8.53.E09.1.454.CMB.1.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctctctcctcctcactctcctcgctcactgcacagggtcctgggcccagtctgtactgacgcagcccgccctcagtatctggggccccagggcagacggtctccatcctcctgcacgtgggagcaagaaccngacagtcggggacaaggttangatgttactattcggtaccgccaggttaccaggacctacgaccgaccccagacctcctactaacttaagtgtaactaaacgaaacgtaacgtccggtacccgtacggtacgggtctacgtacggtaaccctacttaccgtctcgtacccgtacaaacggttccgtaggtacctacttcgtacgtccttcccgtagtactattacttcgtagtccgtacggtacgggtagtaggtacgtaggacggtcttagtaacgtttacgtaccgtcgtacccgttaacgttacccttaaggaccgtaacgtaaccggtacgtaccgttacgggttacgtttaaggtttcggtaaccggtttcgggttacccgggtcgggtaacccgggtaccgttaaggttaccccgg

SEQ ID NO: 283364 - DNA, 687 bp, Homo sapiens
  misc_feature: GYAE6OF02HZ0HB.8.53.E09.1.454.CMB.1.raw
  modified_base (293)..(293): a, c, t, g, unknown or other
  misc_feature (293)..(293): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctctctcctcctcactctcctcgctcactgcacgagggtcctgggcccagtctgtactgacgcacgccgccctcgagtactcgtcggggaccccagggccaggtacgggtcctacctactccgtcctgaccacggtggggacgcaacgaaccagccaggtcggggactaggttanagtagttcgtttctaacgtttcgggtacccgtacggtacggttaccgacggtacaaccgaccgccccctaagtacccttccgttactaacttaaactcgtaaactaaacaactaacgtccggacctacgtacgggtctacgtcgtactacttcgtctcgcctacgacgttcacggtcctacttcgcgtcctcgtgtactatcgttcgtgtaccgtcgtaagggtcgaaggtgacggagttcctagttacgtttaacgtacgtccgtacgttaacctcgttaacgtagtaacctaaccgtacgtacccgtttaggttaaccgttttaggttccgggttaccggttcggggtttccgggaccgggtaaccggttaccggttacggttaaccccggg

SEQ ID NO: 283365 - DNA, 691 bp, Homo sapiens
  misc_feature: GYAE6OF02JC5V1.8.53.E09.1.454.CMB.1.raw
  modified_base (360)..(360): a, c, t, g, unknown or other
  misc_feature (360)..(360): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacgcacgccgccctcgagtactccgtcggggcccccagggcacggtacgggtcctccgattcctccgtacgcaacgtggggaacgctaagaaacccagctaacggttccggggactaagggttaatggtaagttggttactacgttcggtaaccgtccgtaggtccagggtaccacgaccnccccgagacctacctgtaacttaatacgaaacaaactaaacaacgtccggaccttacggtaaccgggtcttcgtacgaaccgtacttccgtacctcggaccctacgtacgtacgtccgggtctaacgttccgcgttccctaccggttagtacctatacgttcgtacgttccgtaccggtagggtacgtaggtcgtacgtggtacttaggttacttacgttacgtactacccgtaacttaccgtacggtattaaccgaacgtccgtaactacggttaagtcgttacgtcggttcggtaccgggacggtacgggtaccgttaaggttacccgg

SEQ ID NO: 283366 - DNA, 934 bp, Homo sapiens
  misc_feature: GYAE6OF02H0WGB.8.53.E09.1.454.CMB.1.raw
tcagctcgcgtgtccacgaccggtgctcgatttagagagagtgtgttgggtttggggggctctgcttcagctgtgggcacaagaggcagcactcaggacaatctccagcatggcctggtctctctcctcctcactctcctcgctcactgcacacgggtcctgggccccagtctcgtactgacgcgacgccccgccctcagtactccggtcggggccccgagggccaggtacggtcctccgacttcctcctcgccgacggtcggggacgacaacggaaccacggtaccacggtaccggggctaagggttactgtaacgttcgttacgtagtttacgggtacccggtaccgtaacgggttacccaacgggtaccaaccgacccggtaccccccaaagttaccccttaccctaacgttaaactttaaacggttacgaaaaccttaaactaaaccgtaaaccgtcccggtaccccgtcgggtaaccggggttccttacgggtaccgtaaccggttactttcccgttccgtccgttacccctaacgtaacgttcccgtaccggtacgttacccgtttacccgttccgttccccgtttacccggtcgggttaaacctacgttttaaaccttccgggtttaccggttcccggttaacccgggttacgggggtacgggaaccggtttaagggtaccgggtaccgggtttaaccgtttacgggtttaaaccgtttaaccgttttacccggtttaacccggtaccccgttaaccgttaacccgtttaagtaacccgttaaaaccggtaacccgtttaacccgggttaacccggttaaggtttaaccgggtttttaaccgttcggggtttccgggtttaacgggtttaccccgggggaccggggtttaaacccgggttaccccggttaagggttttacccccggg

SEQ ID NO: 283367 - DNA, 750 bp, Homo sapiens
  misc_feature: GYAE6OF02I2HXC.8.53.E09.1.454.CMB.1.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagcccgccctcagtatcgtcgggccccgagggcaggaggtctccatctcctgctacgtggngacacgaaccngcaggtcggngtaggttatgtatgttctagttcggtaccgctacggttcgacggctacgcccgaccccgagtacccttcctacgtaactttaacgtacgaactaaaccgtaaacctacgtcccgtacccgtacgggtacgggttcctagtaccgtaaccgttcttcctcgtccggtaccctaccgtaagttcccggtacggtccttaccgtttccgtcccggtaacccttcccggttcggtaactacgttacgtttccgtacggttcccgttaaggcggggtttaggaacggtacggttagggtaccgtctttaacgggtttaacgttttaaacgttccgttaccgtacccggtttaacccttacgttaccgggtacttaacccgtaaccgggtcctttacggtaccgtttaagggtttacgttttccgggtaaccggttttcggggttaacccggccgggggtttacccggtaacccggttaaggtttcccccggg

SEQ ID NO: 283368 - DNA, 702 bp, Homo sapiens
  misc_feature: GYAE6OF02GKSLY.8.53.E09.1.454.CMB.1.raw
  modified_base (193)..(193): a, c, t, g, unknown or other
  misc_feature (193)..(193): n is a, c, g, or t
  modified_base (257)..(257): a, c, t, g, unknown or other
  misc_feature (257)..(257): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgagggtcctgggcccagtctgtactgacgcacgccgcctnagtatcgtcgggccccagggcaggacggtctccgactctcctgccacgtgggacgcacgaaccngcgagtcgggactaaggttacgtgtagttgttcgtagttcgggacccgtccgtacgggttccaggtccaccgtaccgacccccgtaagacctccctaactaattaagtacgtaaactaaaccgaacgtaaccgtccggtaccccgttacggtacggggttccttacgtacgtaacccggttaacttttccgtcgttccgtaccctaccgtaacgttcgtccgtaccgttaccttccgtaccgtccccttaccggttcgtacctagtttccgtacgtcggttaccgttccggtaagggtacgtagacgtcggaacggtcttagtactttacgttctacgtacctaccgttactaaccgtcgtaacaacggttcgtaacgttcgtttaagttacggtttcgtcggttacgggttccgggacgggtacccggtacgtaacgttcccgg

SEQ ID NO: 283369 - DNA, 771 bp, Homo sapiens
  misc_feature: GYAE6OF02GU7AM.8.53.E09.1.454.CMB.1.raw
  modified_base (249)..(249): a, c, t, g, unknown or other
  misc_feature (249)..(249): n is a, c, g, or t
  modified_base (437)..(437): a, c, t, g, unknown or other
  misc_feature (437)..(437): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctctctcctcctcactctcctcgctcactgcacagggtcctgggcccagtctgtactgacgcacgcccgccctcagtatcgtcgggggccccagggcaggagggtcctccatcctcctgcctacgtgggancaacgaaccagcacgtcggggactaggttactggtattgttactagttacgggtacccgtccgtacggttccgacggccaaccgaccgcccccaagaccctcctactaatttaactacggaaacttaaacaaactaacgttccggaccccttacgggaaccggggttcttaccgtacgtaacccgttnttacccgtccgttccgtacccttacccgtaagttcccgtacgggtaccttccgtttccgtacccggttcccctttcccggtacggttacctaacgtttccgttccgttcgggttccctaccgggtagggttcggaaaggtcgtaagggtaccgttacgtttacgttaaacttttacgtttacctaaccggtacccttaaccttaccgttaacgtaccgaaaccgttaaccgtccgttaacggtttaggttaaccggtttacggtttcggttaccggtttcgggttaccggggtacccgggtaaccggggttaaccgttacgggtttacccccgg

SEQ ID NO: 283370 - DNA, 707 bp, Homo sapiens
  misc_feature: GYAE6OF02IXOUH.8.53.E09.1.454.CMB.1.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (456)..(456): a, c, t, g, unknown or other
  misc_feature (456)..(456): n is a, c, g, or t
  modified_base (623)..(623): a, c, t, g, unknown or other
  misc_feature (623)..(623): n is a, c, g, or t
  modified_base (634)..(634): a, c, t, g, unknown or other
  misc_feature (634)..(634): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgacgggtcctcgggccctagtctgtacctgacgcacgcccgtccctntagtactcggtccggggccccaggggccgtaagggacgggtccttaccattccgttccgngccaacggttggggactacgaacgaaccaggtcgaacggtcggggactaggttacngtattcgtntacgtttacggaccgtcggttacggtacgtacgccaacaccgaccccagtacctcgtataaattaactagaaacgtaaacaaacctcgtacccgccgtacggtacggtaccttcaacggtccgtactttcnccttacggaccctacgtagtctacggcttctcgtacctcctccgtagtactagtcgttacgttagtccgtacgtagggtagtacgttaagtccggaagtacgttagttaacctttacgttaacgtaccgtccctaacttacccggttaataccggtaaccgtaaccncgtttaaccgngtttaaccggttagttaccggtcggttcggggttacggacccgggtaacgggtaaaccgttgttaaccccggg

SEQ ID NO: 283371 - DNA, 663 bp, Homo sapiens
  misc_feature: GYAE6OF02GKNGL.8.53.E09.1.454.CMB.1.raw
  modified_base (242)..(242): a, c, t, g, unknown or other
  misc_feature (242)..(242): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtctccatctcctgcactgggancagaaccagcagtcggggcaggttatgtatgttacagttggtaccgccgtaggttccaggccacgacgcccccagacctcctctaattaatgtaactaaacaacaacgtccggaccctcgtacggggtcctcgtacgaaccgtactttcctcgtcgaccttccgaagttcgtacggcctacgtttcctacgtcccttcccgttcggtactacgttacgttcgttacggttaccgttacccggtaggggtacggtaacgggtattacgggacggttcgttagttaattttaacgttaccgttcggtacccttaaccgttaccttagtacgtaaacaaccgtaacgtcccgttaggtacgtttacgtttcggtacgtttcgggttaccgggccgggtaccgggtacccgtaggtttaccccgg

SEQ ID NO: 283372 - DNA, 793 bp, Homo sapiens
  misc_feature: GYAE6OF02IKKIG.8.53.E09.1.454.CMB.1.raw
  modified_base (137)..(137): a, c, t, g, unknown or other
  misc_feature (137)..(137): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagctcgcgtgtccacgaccggtgctcgatttagagagagtgtgttgggtttgggggctttcagctgtgggcaacaagaggcagcactcaggacaatctccagcatggcctggtctcctctcctcctcactctccncgctcactgcaccgtacgggtcctcgggaccctagtctgtactgaccgcacgcccgtccctcgagttacgtccggtccgggggacccccgagggccaggtacgggtccctacctacgttccctcctcggcctaccggtggggacnccaacgaaaccngccgaaggtccggggacttagggttactggtaacgttgtttactacgtttaccggggtaccccgtaccgtacgggtttacccgacgggtacccaacccggtaccccgaccccccgacgttaaccccgttccctaacttaaacgttaagtaacgtaaacgtaaaccaaacgtaacggtcccggtaccctagggtaccggggttctacgtacgtaccgtatttccgtaccttcgtaccctacgtagtccgagtccttaccgttcctccgtcccctaccggttcgttactacgttcttacgttcggtaccgttccgggagggtaacgtaggtacgtcgacgggttcgtacgttactttacgttcgtaccggtcctacttctaacggtacaccgtaacgtcgtacgttagttaacggttcgtttcggtacggtttccggaccggggtaccgggtacccggttaacggttccggttaacccggttccgtacccggttaacccgg

SEQ ID NO: 283373 - DNA, 674 bp, Homo sapiens
  misc_feature: GYAE6OF02JP0EL.8.53.E09.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (291)..(291): a, c, t, g, unknown or other
  misc_feature (291)..(291): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctctcactctcctcgctcactgcacagggtcctcggcccagttctgtactgacgcagcctcctccgcgtccggtctccgngacagtcagtccacatcctaccgtgcgtactgggacnccagcgagtagacttacaattactatctacgtcgtaaccaacgacctacccgnggaacctaaccgacccctaacgtcattcgttacgttttacggagttacaatacggtccgaccctacggacgggttcccagtactccgttctctcgacgtctacgtacgtcgtcgaacacctccggacctccgtcgtaccgtcgttcgacggtctaccaggtacgtagacggtactgggaccttgtagttaactagtttaccgagcgtaacgttccgttacgtacgtttaacctaggggaccgtctaaacggtacggtaaacggttccggggtacgttaacccggggtgggttaacccgggtaacgtaccggtttaaacggccggttttaacccggaggacccgtttacggaccccggtaacgttcccgggtaccctacccggg

SEQ ID NO: 283374 - DNA, 751 bp, Homo sapiens
  misc_feature: GYAE6OF02IO70A.8.53.E09.1.454.CMB.1.raw
  modified_base (185)..(185): a, c, t, g, unknown or other
  misc_feature (185)..(185): n is a, c, g, or t
  modified_base (605)..(605): a, c, t, g, unknown or other
  misc_feature (605)..(605): n is a, c, g, or t
  modified_base (615)..(615): a, c, t, g, unknown or other
  misc_feature (615)..(615): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgacacgagggtcctcgggcccagtctgtactgacncagcccgccctacgagtactcgtcgggggacccagggcaggacgggtcctcactcctccgtgcaacgtgggacgacgaagaaccgaggactacgggtaccggggtactaacgggtttagtacggtattcgttacgtaacggtttccgggtaacccgtaccggttacgggttacccgaacgggtaccaaacctaccggaccccctaaggtacccttccgtacttaaagtttaaccagtaaacctaaacgtaaacctaacggttccggacccttagggtacgggttctacgtaacgtaccgtatttaccgtccgtaccgaccttaacgaacgttcgtaacggtcctactttccaccgtccttcccgtgtaacctacgttacttccgtacggttaccgtacggtacggggtacggaagtacgnggtaccggtnttaacgttagttactacgttacgacccttaacgtaacgtactaccggaactaaggtcgttaccaagtttacgggttacgtttcggacgttttacgggtaccgggtaccggaacggttaccggtaacggttacccgg

SEQ ID NO: 283375 - DNA, 840 bp, Homo sapiens
  misc_feature: GYAE6OF02F6KWV.8.53.E09.1.454.CMB.1.raw
  modified_base (476)..(476): a, c, t, g, unknown or other
  misc_feature (476)..(476): n is a, c, g, or t
tcagctcgcgtgtccacgaccggtgctcgatttagagagagtgtgttgggtttggggcttcagctgtgggcacaagaggcagcactcaggacaatctccagcatgcctggtctcctctcctcctcactcctcctcgctcactgcacagggtcctggcccagttctgtactgaccgcacgcccgaccctcgagtacttcggtccgggggccccaggggccaagggtaccgggtcctacctacgtttccctccgtacgaccgtacggttcgggggacacgaaaccgtaaccgacgtaccgtaacggttccgggggaccgttaagggttactaggtaacgttttcggttacttacggtttaccggtaccccggtacccggttaacggggtttacccgacggggtacccaaccgaccccggtaccccccgaaagttcccccttacctaactaactttaaaacgtcggtaaaaccttaaanaaacccggttaaccgtaccccggtcccgtaaccgggtaccggggttcctaaccgttaccggtaaacccgtttcttaccgttactacccgtaaccgtttaccgtaacgggtttcgaccggttcctaaccgtttccgttcccgtaacccgttcctcggttcctaacgttacgtcgttaccggttcgttacgggtaggttacggacgggtgtacgcgttacgtacgttacgtttactaccgtccgtacctacccgttcgtaattaccgaacgtacctaccgtacgttacgtggttacgtttacggcgttttccgggccggttaccgggacggtaccgttaaggtcccgtaccgtacccgtaacccgg

SEQ ID NO: 283376 - DNA, 726 bp, Homo sapiens
  misc_feature: GYAE6OF02IRP9J.8.53.E09.1.454.CMB.1.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (364)..(364): a, c, t, g, unknown or other
  misc_feature (364)..(364): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctctctcctcctcactctcctcgctcactgcacgagggtcctcgggcccagtctgtactgacgcacgcccgccctcagtactcggtcggggccccagggcaggtacgggtcctctatcctccgtgcacgtggancaacgaaaccaggcgaaggtcgggactaacggttanagtaagttggttactagttcggtaccgtcgacggttccgaggccaacaccgccccagtacctcctacgtattaanagtaactaaaccgaaactacgtccggtacccgtaggtacgggtcctacgtacgtacccgtacttcgtaccgtccgtccgtaaccgtaaggttccgtacggtaccgttaacttcccgttaccggttccccgttaccgttacggtaccttaacgttaccgttccggtttacgtacccgttacggtaagggtcgtacggagttacggtcggtactagttaacttactttaccggcgtacctaaccgttactaagggttacaaccggtaagtccgttaccggttaagttacggtttaacggtttcggtaccggttaccggggttaccgggacccgggtaacggttaaccggtacggttaaccccgg

SEQ ID NO: 283377 - DNA, 795 bp, Homo sapiens
  misc_feature: GYAE6OF02HOOHF.8.53.E09.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgagggtcctgggcccagtctgtactgacgcacgcccgccctnagtactcgtcggggccccagggcaggacggtctccgattcctcctagacctacgtggggacgacgaacgtaaccgagacacggtacggggctaaggttactagtacttagttactaacggtttacggtacccgtccgtaacgggttccgaacgggactaccgaccgacccccgaaggtacccttcctacgtaatttaacgtactaaactaaaccaaactaacgtaccggtacccttaggtacggggttacctaccggtacgtaacccggttattcccgttccgtacgtacccttaccgtaaacgttccgtaacggtccttaacccgtttccgtacccgttcccgttaacccggttcggtaaccttagttaacccgttcggttcggttacccgttacccggtaaggggttacgggaaggtaccggtacggacgggtttacctaggttaacgttttaaccgttaccgtaaccggtccctaaccgttactaccgtacgtaacccgacgttaccggtcccgttaaggttaccggtttagttttccgggaggttttacccgggtgggtacccggggttaccgtacccggtacgggtttaccccgg

SEQ ID NO: 283378 - DNA, 901 bp, Homo sapiens
  misc_feature: GYAE6OF02HV6QR.8.53.E09.1.454.CMB.1.raw
  modified_base (95)..(95): a, c, t, g, unknown or other
  misc_feature (95)..(95): n is a, c, g, or t
  modified_base (208)..(208): a, c, t, g, unknown or other
  misc_feature (208)..(208): n is a, c, g, or t
tcagctcgcgtgtccacgaccggtgctcgatttagagagagtgtgtttgggtttggggggctctgcttcagctgtgggcacaagaggcagcactnaggacaatctccagcatcggcctggtcctcctctccctcctcactctcctcgcctcactgccacgagggttcctcgggccccagttcgtgttacgtcgacgccgacggccccncctacgagttactcgggttaccggggccccgagggccgtaacggtagggttaccaccgtagttccccttcctaggcctaccgggttagggacgacgaaacggaccgacggacgacgggtccggggacgttaacggttgtacggttagtttacggtttacgttacggttacgggttacccgtaaccggttaccggttaccggaacgggtcccgaaccgtaccccgtaccccccgtacggttaacccctaccttaccttaaagtttaacgtaaccgttaaaactaaaacccgtaaacctaaaccggttaccccggtacccgttcgggtaaccgggtttcccgtaacggtaccgtaccgttagttacccgtctaccgtcccgttaacgtacgttccgtcgacctttaccgtccttaccgtcccgttcccgttagtcctaacgttaccggttacgtttccggtaccgttaccggtaggggtacgacggggttaagtagtaccgggttagtttaacgttaacgtttacgtttaacgcccgtttacccgtaacccgtttacctacggtacctaaccggaccggttaaccgtaccggtttaaggtttaacgggttttagtttccggtttacgggtttccggggttacccggggtaacccgggggtacccggttaaccgggtttacccgttaacccccggg

SEQ ID NO: 283379 - DNA, 726 bp, Homo sapiens
  misc_feature: GYAE6OF02FQF17.8.53.E09.1.454.CMB.1.raw
  modified_base (264)..(264): a, c, t, g, unknown or other
  misc_feature (264)..(264): n is a, c, g, or t
  modified_base (621)..(621): a, c, t, g, unknown or other
  misc_feature (621)..(621): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacgtagggtcctgggcccagtcctgtactgacgcacgcccgtcctcagttactccgtcgggggcccccagggcaggtacgggtcctccattcctccgtgccgtacgtgggacncgaacgaaccgagaccacgggtccgggggtacctaaggttactggtaactttcggttactaggtttaccgggtaccccggtaccgtacgggtttcccgaacgggtaccaaccggaccgacccccgaaggtacccttcctaacgttaacttaacgtacggtaaactaaaccaaacgaacgtttcccgggacccgttacgggtacggttccttacggtacgtaaccggttacttccgttaccctcggacccttacggtacgtttcgacggtaccttaccgttcgtccgttacccgtccgttggtacctgttaccgttacgtcgttaccgtacggtgggtcggtaaggtgtcggacgttnttagttacgtttacgtccgctaccctccgtaccagtccgataccggacgttcgtaggtacgttagtcggtgtttccggaccgggtcgacggtacgtcggtacccg

SEQ ID NO: 283380 - DNA, 668 bp, Homo sapiens
  misc_feature: GYAE6OF02G06PD.8.53.E09.1.454.CMB.1.raw
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (296)..(296): a, c, t, g, unknown or other
  misc_feature (296)..(296): n is a, c, g, or t
  modified_base (418)..(418): a, c, t, g, unknown or other
  misc_feature (418)..(418): n is a, c, g, or t
  modified_base (524)..(524): a, c, t, g, unknown or other
  misc_feature (524)..(524): n is a, c, g, or t
  modified_base (588)..(588): a, c, t, g, unknown or other
  misc_feature (588)..(588): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcaggtccgccctacgatacgtccgtcggggccccgagggccaggtacgggtccnccgactctacctgacacgtagggancaacggaacccagcaacggtccgggacgagtttacnggtatgttcgtagttccggaaccgtacgtacggtaccaggaccaccgaccgcccccagtaccctcctagtaattaacgaagaaactaaacaaccaaagtccggacccgtagacgggttaccncgtagtacccgtagttccagtcctaccgtaacctacggtcttcggccttacgttccctaccgttcccgttccgtaggttacctagttaccgttcgtacgttcccgngaacgggttgaacggtataggggacctgtacgtatttaaccgcgttacgtacccattacccgtnacctaaccagttcgacgttatcggtttaacgtttcggacgttcggggttaccggaccggaacggttacgtagttacccgg

SEQ ID NO: 283381 - DNA, 819 bp, Homo sapiens
  misc_feature: GYAE6OF02FII18.8.53.E09.1.454.CMB.1.raw
  modified_base (192)..(192): a, c, t, g, unknown or other
  misc_feature (192)..(192): n is a, c, g, or t
tcagctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacgaggtcctgggcccagtctgtactcgacgcacgccgcctnagtactcgtcggggccccagggcacgggtacgggtcctaccgtaacttcccgttccgtcggtaccgtaacggttcgggggaacgtacccgaacggaaaaccccgagtccgtaacgggtacccgggggtacttaaacgggtttaacgtacggtaaacggttttcggttaccgttaacggtttacccggggttaaaccccgtaccggttaacgggtttacccgaacggtaccgaaccgacccggaacccccgtaacggtacccttaccgtaccgtaaaacgttttaacgacgtaaaacgttaaaccaaacgttaaacccggtcccgggacccgtttaaccggggtcgggtttaccgttaccggttaaccggtaaccgttaaccgttcccgtcgttaccggtaaccctccggtaacgttccggtacgtcttacgtttccgtcgtccctaccgtagtctacgtacgttctcggtctacgggtgtacgtaggcgttggacgacgttacgttacttactacgtcgaccttactcgttaacgactaccgaacgtacgtccgttagtaacctttacgtttaccggcggtttaccggttccggggacgttaccggggtaccttagggttaccccgg
